United States Patent 7,745,391 (HUMAN THROMBOSPONDIN POLYPEPTIDE) - sequence listing, part 169

SEQ ID NO: 428255 - DNA, 1037 bp, Homo sapiens
ctttaacattttattttcctgttctgcagagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaaggcaagttgtattttagtcactttgaggcgaatggggcctacgtgctgttttactcttggctttaacacttccatgcgaggggttgtctgagcagctgagtcaggactgtgagccctcaccatgaatagtcatctccaggtcacagaacgtgtttagagcctgggcaacatagtgagaccctctctgtacaaaaaacaaattaaaaaaattagccaggtgtggtggtgcgcaccgatagtcccagctgtttgagacgctgaagcgggaggatcacttgagcccaggagcagaggttgcagtgaactgagattgcgcccctgcactccagcctgggtgacggagcaagaccctgtctaaaaaaaagagaaaagagattgagcctgtgttcttgtttggctttttgttttgccatggagaaaaggaggaaggaagggttaaaaataggtgagaaaatgggaaacatggccgcccttccaggcagggagaccggaggtcaggatcccactgtaggtgcacactgggtgcgagggaagcggcatccacagctgctgacaatgtcgggctcctgcggtcctgctgtgggtgtcctgctctcaggaagggagcagtttcacgtaggtcactccacacaagtggaagcagctgtctctgaaactccaggaatgtgcacctttcctgctgttgcttgctctcccgtccttttaatgaacttttacacgtcggg

SEQ ID NO: 428256 - DNA, 967 bp, Homo sapiens
ccccaacctgatgttagtcaaccaacagggattctgtacttacacctgatttgcaaagtggaactggtagctgcctgtgatgatcttctaacaatctatcatgctgacttaacagccttacctatcattcaatgcatcaagtcaatagatgactagtaccatactgatctttcagtattgataaatatcatcttgtatatgttgcagatgcctcagtcaagcatttgtcacagtctttattctgtaaaacactctccatatgctcttcataatccttaaagattattgcagttcagccacttctgtaagtgtttattagcattggcatgttggtagtagtcctgttcttcagaccatagctttgaaccagaatagtgctcttcatctccagagacaaacttccatgcactaacccagcagtaaaggatttggcccctacatgggaaaacagcagtgttggagatattgttgtagagattaaaggagagagttgtgctacaaatacaccaaaggaattagaaaattctgtttaaaattccatttaaaaagcttttataagaataaagatagaaaaatagatatgattatcttgatcattgacatttggaaaacacacaaattcattgctgaggtaaacaatctattatgggacagaatatacattcaataggtggtaaactggatttctcattctagggtgatttaaaattacctgaggctatgcaagtttctgtcataattcttcctcatatttacaaagaagaaagagattaaatgttgaaagggctgcgtagttagtaaagaaagtaatttgaagaagaaaatgtgttacaaactcattaagaataggagataagagaaagattttctgaaatatttccataaaaccccttataacttgtcaggtcaaaaagtaatagtctaaatgcaatgtggtatgtgtactggttttgatcgtagaacaaaa

SEQ ID NO: 428257 - DNA, 3622 bp, Homo sapiens
  misc_feature (3593)..(3593): n is a, c, g, or t
cagtgtgatttcgccatcttctccatggaccactatatacattaatgtttcttaccttctaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggtgagtagcttccaaggtagattttactattgtggtttttttccactgagatgttagatgttcttaagaataaaatgttgctctctggtttcgcaggaaatagattgttctaatctttgaaatcagggtcaattacagatagctataataaagatttccctgagacgggagtcaaaatcagcatccctcagataactgctttatgggctaaaaacaagcacagcatgcaggtattgctcattagctcgtttggttagaggtgtgctgtgttaaaagagccagataaatggattcgagccacttgtaggcacattagctccgctcatgttccctgagcacagataatgtcttttaatccaaaggttgcaaagtgggggccggggatctgcatctagcctgcatatcacattgacccacacaaaagatttttaagtacgaagtaattgccagtatttaaaagacatgagatttcccaatctggatttccaacttttcttgagaagtcataatatctggcactagtaggtctacagtcccatatgttggcagctggagccgaagagcaccactccctgtaggtgggtcattctctctctcctaccataatccccaccgcttcctgtctcagcggacctacttaagttgttcactttacttgcctggtctctgaaggcatttgagtttgcctcttctgctttaatctcatcctgacaggaggggtcgttgatttcaactggattgagagactgtgaaggaactcggttacaaatccataacaaatgactggaaaagccacacaactcttacatactgatatttagaaaggtgcttttgttctccagactccagtgattctgcactgggcattatggaagacttgtgatagatcagagaagagtcatgttgaaaacgaaacgcagggaaaccgtgcaagagagaacagtagaaaagatttaacatgtagcttcccagaaagaatgaatgaggaatgtgtttgtgaatgcctcatgacataagcatctgaagaagagggtcgtgggctgggcgcggtggctcacacctgtaatctcaacgctttgggaggggaggcaggcagataacttgagatcaggagttcgagaccagcctggccaacacaatgaaaccgtgtatctactaaaaatacaaaaattagccaggcatgatggtgtgcacctgtagtcccagctactcaggaggctgaggcaggagaattgcttgaacccaggaggcggaggttgcactgagccgagatcacaccaccgtactccngtctgagcgacagagcaagaatctgtctc

SEQ ID NO: 428258 - DNA, 7294 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggcttgagtgcagtggcacaatctcggctcagtgcaacctccgcctcccgggttcaagcgattctcctgcctcagcctcgtgagtagctgggattacaggcgtgcaccaccacgcccagctaattttgtatttttggtagaggcagggtttctccatgttggccaggcttgaactccggacctcgggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgtgagccactgcgcctggcctaaatttcataacagaaccatgacagcagaatctacctttgcaataagaatgtttcccaggagttagagaccagccctgggcatgatggtaaagaccccagc

SEQ ID NO: 428259 - DNA, 6792 bp, Homo sapiens
  misc_feature (6577)..(6577): n is a, c, g, or t
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctccctttacaaatacttttctaacaaaatagcattataatgaagtttttacttaattccattatttatatgttgaccgtggaatgtagtggtttaacacagtattcatgtgggacatctcattactttgtagctgtggcttattaaccagtgaatggtgtggtccttaaagaaatgcgtgtccttctgcgtgatgtgggaattcggcctgtatnttaaagatggtgtggttcctcccttgttgatttaataaacacggtccttaaacaaagacccacccacatcaccccacaacaaaaagggcgcgcaattcccccggcacactcaccatttgaaaggccaaaactaaaaacgcgggtcatgcgcacaccgctcaaacctgggtgcccacacagatattctccggcggtctaacacaccgcctcttaaa

SEQ ID NO: 428260 - DNA, 4465 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgatta

SEQ ID NO: 428261 - DNA, 4275 bp, Homo sapiens
gtagtttttgtagagacaggtttccgccatgttgcccaggctggtctcgaactcctgagctcaagcgacccacccaccttggcctcccgaagtgctgggatcacaggcgtgagccactgcacctagctacttgttgtttttactctctgtctcccttcactagaatgaacctccaagaaggcaaggattttggtctgttttgttcactggtgtgtccccaacacctaatctagtgtcttgcacgtagttggcactcaaaaatatttgctggatgagtggagagtgaagggatgtagtctctgccttactcctgccacctcacttggggtcttcttttcctgctcaaacaggcacagttctgcataagcagatgtccaccaggaaatggggcacctgtcttttctcctagtatccttgtatctatggaagattctcttagaagccccctcacttggcttagggtgggcagtaatttctgcccctctcttgggaaaggaagaagaaaagccgtagtgctgacacagggctgctgaggccccgctctgaagatcccctggaattcctccagtgttcacttagagagatcggggtcatgtctttggtgactgttacattgcaggggttagggatgtgtctggtggctgtccttagaatgtggaggtacttagcacctctcatccttgcttcaagagttcaaccacaatttagagaccataggaaaagaactgttctgcatcctgttatgtgtttaaagataagtgaagtcaaagtgtttgtaagaccttcagattcagaggggtgagatgtttcttcattactttgtgatgctattaacatttagattcttttaaatttttactatccccattttcagctagtttattgggatttcccagattcaaacagatggactcataaataaacctcccaaaaaacaaaagctaataacttgcatagtgcctgccattctccaagcactgttgtaagccttttaccatattaccctatttaatcctctcaaccatccttggaggagctactgttaccatcccaacttcacagatgaggaaactgaggtacagagagattatgtgacttgcctaaggtcatgtagccagtaagaggcatagctggggtttgaacccaagcagtgcagcttctatgctcttaccagtaagctatacagcagcattgagaagtggattggtcccaaagaatagtaagtacacctctgtccagatacacccattgtttctcacagatatcagcaagcaataatgctcccctgtctgggtcctctgtgtctccactgccaacactctctctctgctctctcatcccgtcaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428262 - DNA, 6170 bp, Homo sapiens
atagcttaagtagcagctgatgttaatgacagaggctgcgcaggtattctacgttcaggatcactaaaggctactgaggccgggatgctcttactgtatgggagagaggtcgcgggtggacgctgattgcagggctccgacgaggtgaagactgttacaagtaatctattagccggtgggatactacctgtcagagaggtcggatgccgatgctgtaacaatgattttcctactgtaatcctgctgctgatgacagtctacatacttcaagtctagttcattgtgagatatggttaaatgtctctcataatgtccaagaagctattgctatgcagagcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428263 - DNA, 4214 bp, Homo sapiens
gtaggctagtagaggctgggtgttgaatcggcgaggaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428264 - DNA, 1524 bp, Homo sapiens
tatgatctctagaggtatccctagtaaatctcggcgtatcgcaagtctgctcatctgttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428265 - DNA, 1710 bp, Homo sapiens
  misc_feature (56)..(56): n is a, c, g, or t
atgctttatttttcctgtggctactagttagcaatccataggggttgtgaattttnaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaagcccagctaattttgtatttttggtagaggcagggtttctccatgttggccaggcttgaactccggacctcgggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgtgagccactgcgcctggcctaaatttcataacagaaccatgacagcagaatctacctttgcaataagaatgtttcccaggagttagagaccagccctgggcatgatggtaaagaccccagc

SEQ ID NO: 428266 - DNA, 1573 bp, Homo sapiens
  misc_feature (56)..(56): n is a, c, g, or t
atgctttatttttcctgtggctactagttagcaatccataggggttgtgaattttnaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgtgagccactgcgcctggcctaaatttcataacagaaccatgacagcagaatctacctttgcaataagaatgtttcccaggagttagagaccagccctgggcatgatggtaaagaccccagc

SEQ ID NO: 428267 - DNA, 1617 bp, Homo sapiens
  misc_feature (56)..(56): n is a, c, g, or t
atgctttatttttcctgtggctactagttagcaatccataggggttgtgaattttnaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaatcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgtgagccactgcgcctggcctaaatttcataacagaaccatgacagcagaatctacctttgcaataagaatgtttcccaggagttagagaccagccctgggcatgatggtaaagaccccagc

SEQ ID NO: 428268 - DNA, 3051 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagctcgctgcgagtggtgagctccctgtagtgagctccctgcgagtagtgagctccctgcgagtagtgagctccctgcgagt

SEQ ID NO: 428269 - DNA, 2466 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggatttagtggggataaaaaattcaaacaacagggatactagtgagttatcaaagcaaccgaaccttgcgaaatgaggtcagtaaagccagaagcaagatgagttgccaggattttccaagatgggtgtaagtcaggatcccttgatgactcaattcagtgataccaagagatgcctgattcatcgatacaacgaagtaactcgcatgcatggaaccggct

SEQ ID NO: 428270 - DNA, 498 bp, Homo sapiens
ggagtgtgcctcttgaatgtggactcgaggagccgggtaagtcacgcagcctccttgcagacagcaaagggcttccctaacatgactctggacaacctcatctggcccactttactgcagagtttgtgaccagaggtggggattttctcaagtcctaaaagctgatggtaggagcagacacattccctcgagagggcagcgggggagctgtggagggaatggacgcggctctcatgcctgcagcaccctgtgcatagtggggaggtcaggggaaaagggtgaacctgtaaagatgtgtttggaggcaagaggccctgttctgggaatgttgttgacctgtggtttcaacgttatttcagaaagaagagaagcctgcagaagaacatcctaaaaaagtatgaaccagttacaccttatcttagcgtctccattttaattttgagtgtggagggcaaattggatgattctatccattgccatcctgaactgttccaatca

SEQ ID NO: 428271 - DNA, 800 bp, Homo sapiens
ggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaatccccagcactttgggaggccgagccgggtggatcacccgaggtcaggagttcaagaccagcctggccaacatggcgagaccctgtctctactaaaaatacaaaaattagctgggcatggtggcaggtgcctgtaatccgagctactcgggaggctgaggcaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtga

SEQ ID NO: 428272 - DNA, 343 bp, Homo sapiens
cactcatggcactgcacgggctcccctggcgcccacctgagactgagttctcagaggtcagagggcgtgttgtactggtgccggccttcctagcacctggaaccgtggcaggttcccagtggatgtgtgggaggttaattcttgtagtggtggtgttagagtactgtacttgccgctaggcctgctgggggtgagtgatgagggagtgaagtgaacagcgtgtggacttgtggacttcttacccatttgtcttgtcgtcctcacagccagatgaaaactcgctggatttttcctcctgtatgttacggcctgggattaaaaatgctcaggagcttgcctgtgg

SEQ ID NO: 428273 - DNA, 314 bp, Homo sapiens
aatgctaaattgcatactatttaaattgtatgaatctttaagtggtggtcttctgtgctaaatatgtaaaatgcctgtataccacatgttaatagtgtttggttaaaccaatctgcctcacttcctggagctgtgatttcaagattcctaaccttaactgagcttctgtcctttctatcatagatcctggtgataaatatagtgctttcagagaacttgaacagacagcagagaataaacctttaggtaagtttttgagtcctcaaaaggataaattatttccatttttaataaaaaaggggttttcgatggtt

SEQ ID NO: 428274 - DNA, 601 bp, Homo sapiens
gcttctgtcctttctatcatagatcctggtgataaatatagtgctttcagagaacttgaacagacagcagagaataaacctttaggtaagtttttgagtcctcaaaaggataaattatttccatttttaataaaaaaggggttttcgatggttctttcagtggcattccctttattttagtgtgtgtgtgtctgtgtgtttaggagaaaaaaactgaatggacaaaacaatatggtatagtagtgatgtttataatagatactcaaactataagtattctaattcaaaaaaccttaataatagcaaccgtgtttaggctgggtgcagtggctcacgcctgtaatcccagcagtttggaaggccaaggagggtggatcacctgaggtcaggagtttgagaccagcctggccaacgtggcaaaaccctgtctttactaaaaatatgaaaattagccgggtgtgatggtgcgcacctgtagtcccgggtactcgggaggctgaggcaagagaatcgcttgaacccaggcagaggttgcagtgagccgagattgtgccactgcactccagtctgggtgacagagcaagactccatctcaaaaaaa

SEQ ID NO: 428275 - DNA, 6525 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428276 - DNA, 6622 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggcttgagtgcagtggcacaatctcggctcagtgcaacctccgcctcccgggttcaagcgattctcctgcctcagcctcgtgagtagctgggattacaggcgtgcaccaccacgcccagctaattttgtatttttggtagaggcagggtttctccatgttggccaggcttgaactccggacctcgggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccaggtgcttcagaagtcctcgtactctagaagcacgtgggggaaacagggtatactacattttgaacatagtgatgaaatttgtcctaattttaaagatgagcctcattacaagttcacatatgactaaagacaatgaagacacagagggcaaaaggaaggaaaacgagggagaacgaggaagaagaaagcacttgtagtgagcagtttacagaaagaaactcacaatggaccctatgaaaagatcctcacccagagggaaagtacatttttaacttacc

SEQ ID NO: 428277 - DNA, 6351 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428278 - DNA, 5831 bp, Homo sapiens
acacagcctctccctccaagtcagagtccagtgccttttgccttacatggcgtccctgggcaaattccttacttctctactgcttcagcctcacacagtgtaccagaagcaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaatggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactttgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggctactaagccttt

SEQ ID NO: 428279 - DNA, 5062 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacc

SEQ ID NO: 428280 - DNA, 957 bp, Homo sapiens
gataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtagttttaagaggcattatatttttcttttctgggaaggtgatttatgtagtccctgtttctttacctcgccattatatgtgtgtgtgaaaagtcaatgtagaactcttccttcaagctaagtacagatttggatgttctcaaatatacagtggcttaagagctctggtctggataacaactgtcttgggaggaaaaaacctctttgtcttctaagtaaatatcagtatgacaatttcacctgtaagttttctgtatataaatatgttaacattagtaaaatctattcactcagagcaaatgtaataaaggagtttaccattta

SEQ ID NO: 428281 - DNA, 2464 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428282 - DNA, 6043 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagtacacttctcatactatgtgtttggcattgactctggttaactcttgtgcagcaacacctacgagatgctatcacacacgcgccagctgcactcctgcaccagccgctgcaacgactgcacctcacgtggtggcggggactcacattcacaagacgggacgggaacatgcagtaataaaatagctttttaaaaaataacacatataaattcatcacataggattatgcttttcactgcaaccttgaaggtggcatttatctcaatctgtgactccagctatttagtggcagacaatcccggtgaggcagcctgtggtcccaccttgtaggtggcagcccctgcaatctggggtctacctgtcggcgtttgctttattgtgggtggagcagctgctgcagaatctgtgagttgactcaccagtccctacagttctgctaccaaagtggtcttcaatttaggggcctgacccctccccagctggagacaagctgccatctccagggctcgctgtaaacagcctccactcttgggctgaataagcactcccaagaagctgggcccctaccaacagattaatcggctgcagagtgctcatcccctccccacacccccatccacccctgcctcctcctcctttccactgctttaaccaaaccttaatgaggtaaggccaggctaggtcagggctcaaaggaaaatgggctcaggaaaacttagtttgcccagccttgtcagctgagattggttttgctttccagccagaagtagaaacttgatgctttttcctttttgcagtgttaaaaaccatatctccagttttattatgttccatcacagttttggggcaaagccagaaagctgacttgtttgcttcaaaacacaaaccaaggcactgtcttctgtgcttttcagggaggtgggaaggtaaaggagactgcccactataggggctcagttcccccaaaggccttgcacaccttctgataaaccccctggctgaggcaatcctactggctgtgcagacaaagatgtgacagcagcactagatgctgacccaacaagcagtgctgggcctgggcggtggggcatgttcagcactgcgggcagcagtcagcacatgcaagacattcagtgagcagagggctgccctcggcctccaactgcagccgccctggcgcgtgaaatgaaattggtgggccttcctaggattgtaaaatgggacttgtcatttgtgtgaggttgaaatctactatactttgaatatggcaactgttttcaaccactgaagcaaagaaggtaaaggccagatggggaatgaaaggtaaggtactgtggtctatttccaaatttgggagcaatgtgtgtaacttcaactgttggagtaaatgagttatggaaaagccacaatttctaaaatcccaaggttctaccaaaggagtgaggttcctggggaaacaggcatgaggcagcagctcaggctgatgtgtcctgtgcgatataaaaagctgtggcctgatctctaaagtggggcttttgaaaatcaccagtccacaactacctgcctggctagtttaacctagactgcttcagaagcaagggagggggataatggactggagaaaaagctgacacaaaactcaagacaaccagtttcagtacctgggccctcaaagcaatagtgaggactgagaaagtagcaaggggcactgatgtcatctattttctgggaagtgtaatttttaatggtttcattaaaaacttactaaccttctactggaagaatacctcaaatgaaaaattttttttttttgagacagttttcgctcttgttgcccagggtggagtgcagtggcgcgatctcggctcactgtaacctctgcctcctgggttcaagtgattctcctgcctcagcctcccgagtaagtgggattacaggcacgcaccaccagacctggctaactttctttgtatttttagtagagatggggtttcaccatgttggccaggctggtctccaactcctgacctcaggtgatccgcccacctcggcctcccaaagtgttgggattacaggcgtgagccactgcgcccggcctcaactgaaaattcttgatgagattagtcccactgcataggtctcagcactgaggtttagagatgtgagactcagagtaggtttcagttccccggagtgaagggggcatagggaggggcagggcttcccagtgttaactgcctctgcccaaatcatgactcagtcctggtaccacgtcaagatccctttgaaaggaaacatactttgcatcaagtaatcctttgaaactgccacattgaaaagttagtttttaacccaaatataaatctgggagctaaacactagtcacgaagccatctttacttaatgaagaaccaccttgagggagaccagccctgcttgccacttacatggctgcccctgagacggtctgttctgttcatgccccagcagccttttgccttaggtttcaggaccttctgaaccacccttgagggtgtgtgccagcaaatacctcaagtggacttctacttaggaccacttgagtgcacaacttcagcttctagaaggccaagtgtggctgcaattcaggatctgccccaaactcatcagcccttcccaagtttcccaggtgagaacagtatgagctgtgaatttctgtgttggtgtgacaggaatgccacagtggtggtgccagtgatcactttctgaccttccttccttctcagataaaatgttgcacagttatggccttggaggcctaagtagacagcaattaaccagccagtgagaaaacgaatcagcatctagaacaggaggggagggaaccgtaacagataagggagcccacgattagaagcaggctccctgcacagcctctgcctccagcgcaagtaacagacgtttcacatttaaaggctgccaaggtattgctggcgactctcctgtctgtgaacatgcgcaacgggcacaggtacagagaaccaatgagatgtaggcagcaccatctgccacaaaaggttctccatcgcagccccaggagcaaaatcaaacacctctgatgggagcaaggaccctgaacagaagccaacggctggagccaacgggccatgcccttaaaacgaggacttggacaaggagggaaccactggagtgacgtgatgcaagccctcttcggtcactcttggcttccaccaggggtctctgcctccttgatgagaagagaagctggctggctccatgatgacctcgatggcgtactacaggccgatgggcaggccgggcctcagcagcaggcgccaacagaagcacacccagggctgattcaggtccatttcagcataatttttgtggaacaaattaaagaagcagtaataccagagctgtccccacttagggaataaaattttcaaggctgcaagaaactctctgtctacaaaccagtggccattgcctaaggaggctcggggagccaggggatcactatcagtgggataggtgctggcggaaccagcctctccgaattcacccccgcctctcttagcc

SEQ ID NO: 428283 - DNA, 2410 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaatactgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428284 - DNA, 2347 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428285 - DNA, 2654 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaatttgacgtctgaatattatttcttaaaggtctaacaaactaggggggcggactaaagattcccagtgagcaagtattacgtcaccgctcgtataaggacccttgtgaggtataaagagcaggacgtacaacgggggaacagcaggttatatacaattttggtggtttgaacatatatagataattgtgtcagttggtaatatattaaacatagaatatataatagaaa

SEQ ID NO: 428286 - DNA, 1355 bp, Homo sapiens
ctcgttcgtgatgagtagctgagaccctgccactgaaagacaattctgcaccaaggctgagtgttggggtgggagacagcaaaaaacacatgtaaatcaccttgtctgagagggttataaatttgggctgcccaggacatctgtccaagggtgggtgcatctcagagtaattgaggtaagcatggagaccttgtgccctgccacactccccagctgggggacattctgacatttgtgcctcggcccccagccattgtaccccctttggtgtgtagtgtggggtgactcatttgtgtcttgtggcacagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428287 - DNA, 1264 bp, Homo sapiens
gcgctctgcggcccagtggactgcggctggggaccccagcactgacgtcccgtggacttttggaaaaagacttccaaaaagtagcccactttattcacagagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428288 - DNA, 2411 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaattttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428289 - DNA, 760 bp, Homo sapiens
agagaactagtctcgagtttttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428290 - DNA, 706 bp, Homo sapiens
agagaactagtctcgagtttttttttcatgttttcttcacaaatcaaaatttgtttaagtctcattgttagtaattctgggacaggttattaaaggatttaaatttgaacctggctttctcacagctggacataattctaggaaaatactgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428291 - DNA, 2651 bp, Homo sapiens
  misc_feature (1)..(1): n is a, c, g, or t
  misc_feature (157)..(157): n is a, c, g, or t
  misc_feature (201)..(201): n is a, c, g, or t
  misc_feature (520)..(520): n is a, c, g, or t
nttttttttcagatggagtctcgctctgttgcccaggctggagtgctggagtgcagtggcacaatctcggctcactgcaagctccacctcccgggttcacgccattctcctgcctcagcctcccaagtagctgggattacaggcgcccgccaccatntctggctaattttttgcatttttagtagagacggggtttcaccntgttagccaggatggtctcgatctcctgacctcatgatctgcccgtctcagcctcccaaagtgctgggattacaggtgtgagccaccgcgcccagcccctacttcttgtttttcaatgttgtatccagtgaccttgctaaatttgcttattctaacagttggcccctagcatcttgattttctaggtatattgtgttgtctgtgtgtaatgtcagtttttaaatttcttctttcctaatcgttatgccttttgtttctttttcttgcctcattatacttggaatagaagtagtattagcaggcattttggtcttgttcntgaaggtaaccattttggtttccattgtgtggtcccgtcacatttgtttcattctgcaggtgctttttggttccttctcagcaggtagtgccccagcagcagggctcactacaaccctggactcctcaggactcctgggtctgtgagccatacttggttgagcaggctgaacacaccagtatccatcctgtctcaccctcaagtcctcatctaggacatcattcctcttgtcatggtgggtggagccagttcaagtgggaggacaggaggcaggtgtggttggaggaagcagcctgaacctgcctccctgacattccacaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428292 - DNA, 5014 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagtacacttctcatactatgtgtttggcattgactctggttaactcttgtgcagcaacacctacgagatgctatcacacacgcgccagctgcactcctgcaccagccgctgcaacgactgcacctcacgtggtggcggggactcacattcacaagacgggacgggaacatgcagtaataaaatagctttttaaaaaataacacatataaattcatcacataggattatgcttttcactgcaaccttgaaggtggcatttatctcaatctgtgactccagctatttagtggcagacaatcccggtgaggcagcctgtggtcccaccttgtaggtggcagcccctgcaatctggggtctacctgtcggcgtttgctttattgtgggtggagcagctgctgcagaatctgtgagttgactcaccagtccctacagttctgctaccaaagtggtcttcaatttaggggcctgacccctccccagctggagacaagctgccatctccagggctcgctgtaaacagcctccactcttgggctgaataagcactcccaagaagctgggcccctaccaacagattaatcggctgcagagtgctcatcccctccccacacccccatccacccctgcctcctcctcctttccactgctttaaccaaaccttaatgaggtaaggccaggctaggtcagggctcaaaggaaaatgggctcaggaaaacttagtttgcccagccttgtcagctgagattggttttgctttccagccagaagtagaaacttgatgctttttcctttttgcagtgttaaaaaccatatctccagttttattatgttccatcacagttttggggcaaagccagaaagctgacttgtttgcttcaaaacacaaaccaaggcactgtcttctgtgcttttcagggaggtgggaaggtaaaggagactgcccactataggggctcagttcccccaaaggccttgcacaccttctgataaaccccctggctgaggcaatcctactggctgtgcagacaaagatgtgacagcagcactagatgctgacccaacaagcagtgctgggcctgggcggtggggcatgttcagcactgcgggcagcagtcagcacatgcaagacattcagtgagcagagggctgccctcggcctccaactgcagccgccctggcgcgtgaaatgaaattggtgggccttcctaggattgtaaaatgggacttgtcatttgtgtgaggttgaaatctactatactttgaatatggcaactgttttcaaccactgaagcaaagaaggtaaaggccagatggggaatgaaaggtaaggtactgtggtctatttccaaatttgggagcaatgtgtgtaacttcaactgttggagtaaatgagttatggaaaagccacaatttctaaaatcccaaggttctaccaaaggagtgaggttcctggggaaacaggcatgaggcagcagctcaggctgatgtgtcctgtgcgatataaaaagctgtggcctgatctctaaagtggggcttttgaaaatcaccagtccacaactacctgcctggctagtttaacctagactgcttcagaagcaagggagggggataatggactggagaaaaagctgacacaaaactcaagacaaccagtttcagtacctgggccctcaaagcaatagtgaggactgagaaagtagcaaggggcactgatgtcatctattttctgggaagtgtaatttttaatggtttcattaaaaacttactaaccttctactggaagaatacctcaaatgaaaaattttttttttttgagacagttttcgctcttgttgcccagggtggagtgcagtggcgcgatctcggctcactgtaacctctgcctcctgggttcaagtgattctcctgcctcagcctcccgagtaagtgggattacaggcacgcaccaccagacctggctaactttctttgtatttttagtagagatggggtttcaccatgttggccaggctggtctccaactcctgacctcaggtgatccgcccacctcggcctcccaaagtgttgggattacaggcgtgagccactgcgcccggcctcaactgaaaattcttgatgagattagtcccactgcataggtctcagcactgaggtttagagatgtgagactcagagtaggtttcagttccccggagtgaagggggcatagggaggggcagggcttcccagtgttaactgcctctgcccaaatcatgactcagtcctggtaccacgtcaagatccctttgaaaggaaacatactttgcatcaagtaatcctttgaaactgccacattgaaaagttagtttttaacccaaatataaatctgggagctaaacactagtcacgaagccatctttacttaatgaagaaccaccttgagggagaccagccctgcttgccacttacatggctgcccctgagacggtctgttctgttcatgccccagcagccttttgccttaggttcgttttcttaccccaaatgttccttgctgctttgcacatgcaccact

SEQ ID NO: 428293 - DNA, 2726 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagtacacttctcatactatgtgtttggcattgactctggttaactcttgtgcagcaacacctacgagatgctatcacacacgcgccagctgcactcctgcaccagccgctgcaacgactgcacctcacgtggtggcggggactcacattcacaagacgggacgggaacatgcagtaataaaatagctttttaaaaaatacaaccaatttttatatttcaaaaatatttgaactcaaataaattaatttcttaaaaagtacacttct

SEQ ID NO: 428294 - DNA, 2402 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccagtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 428295 - DNA, 2477 bp, Homo sapiens
  misc_feature (74)..(74): n is a, c, g, or t
  misc_feature (77)..(77): n is a, c, g, or t
  misc_feature (80)..(80): n is a, c, g, or t
taggtttggggttggagcggctggtcacgtggctggcccgcggcggtgcgcggcgttgggtcagcgggtctggnacnggnggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagcaatgtacttccaagaattatttcacgtactgaatggaacttgatgccttttattagccaccaatttacccgatgtcagatttgttaaatcaccctttttcacaattggcccatatttttaggaacaaaaggggggattcgggcatgcctttaggccaggagtaacgggcggagggggacgggccaacaattgtggttagtgtc

SEQ ID NO: 428296 - DNA, 348 bp, Homo sapiens
gcgtccggactagttctagcccacgcgtccgatttattatgaagaccagtgaattacgataattaagttctctcactttaaatatcgtaattcactggtcttcataataaataattataataatatataaaaggagacagtggcctgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428297 - DNA, 3810 bp, Homo sapiens
gatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428298 - DNA, 2809 bp, Homo sapiens
aaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428299 - DNA, 2165 bp, Homo sapiens
gaaagactctaaagatcttttctagatgtttgttgtgttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428300 - DNA, 3756 bp, Homo sapiens
gatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428301 - DNA, 3756 bp, Homo sapiens
gatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccactggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428302 - DNA, 1818 bp, Homo sapiens
tctgaggatacccgagtcttgctcccatcaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaa

SEQ ID NO: 428303 - DNA, 4130 bp, Homo sapiens
gatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaaaaaaaaaaaaaaaaaaaaaaaaaaaaaaaaaatttgggggaggagccccataaaaaacgtttaagaaacaatagccgtagggaacacggggacacaatagagaaagcgacacgtgggcgagagacgagtcccatagaagaccacgcgggtagcaggaaaaggagggcgcgagagatcaccacgcgaagaaaaaagccccgggggaaaaaacagaaggtctggaaaacagtcccgatgaagggattcgagagatcaaaaggggatgcaacaacgagcgccacaagagaagaccgcataaaaagtacccccggtggcggaac

SEQ ID NO: 428304 - DNA, 3246 bp, Homo sapiens
gatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtaagaaggtgttttaccctgtggtgttcagtctttacaatcctgccattgtttatgccaaccaggaagtgccaccacctgtggagcagcagctggttcacaaaaaggattctggcttttggcgagattttggctttggaatgacttgtcagtatcgttcagatttcctgaccattggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagcttatgtgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtggggtgatcatctgcaggataaggtgatcttctgcacgata

SEQ ID NO: 428305 - DNA, 3429 bp, Homo sapiens
gcaccaggcgcccagtggagccgtttgggagaattgcctgcgccacgcagcggggccggacaggcggtaaggatctgattaggctttcgaacttgagtttgactgatgtcttctgtgtggtgtccgctaaatcccacagcatataggatcagtcgcattggttataaggtttgcttctggctgggtgcggtggctcatgcctgtaatccaacattgggaggccaaggcaggcggaccacctgaagtcgggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttaaaaaaaa

SEQ ID NO: 428306 - DNA, 3140 bp, Homo sapiens
gaagtgcagcacagaaagggggtccgtgggggacagtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcatta

SEQ ID NO: 428307 - DNA, 3177 bp, Homo sapiens
gaagtgcagcacagaaagggggtccgtgggggacagtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttaaaaaaaa

SEQ ID NO: 428308 - DNA, 3286 bp, Homo sapiens
gcaccaggcgcccagtggagccgtttgggagaattgcctgcgccacgcagcggggccggacaggcggtaaggatctgattaggctttcgaacttgagtttgactgatgtcttctgtgtggtgtccgctaaatcccacagcatataggatcagtcgcattggttataaggtttgcttctggctgggtgcggtggctcatgcctgtaatccaacattgggaggccaaggcaggcggaccacctgaagtcgggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttaaaaaaaa

SEQ ID NO: 428309 - DNA, 2869 bp, Homo sapiens
gaagtgcagcacagaaagggggtccgtgggggacagtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggtgggctacgtcgacgtagcccacctgacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactt

SEQ ID NO: 428310 - DNA, 673 bp, Homo sapiens
gcaccaggcgcccagtggagccgtttgggagaattgcctgcgccacgcagcggggccggacaggcggtaaggatctgattaggctttcgaacttgagtttgactgatgtcttctgtgtggtgtccgctaaatcccacagcatataggatcagtcgcattggttataaggtttgcttctggctgggtgcggtggctcatgcctgtaatccaacattgggaggccaaggcaggcggaccacctgaagtcgggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagtggaggctccttatggattaaattgtggtccctggtcgcctggacctgaactaaccggcggaaccctgaatacctggaacttcaaggtcatatgacgttctggttct

SEQ ID NO: 428311 - DNA, 420 bp, Homo sapiens
atattttgaccttcaatctggacattgtcattgtaagatctttgtcctcgttggattttataagtagtattgggggatcagctttacttaacagttgtccttgcaaatagcattttgctgaaaaggaccatttctaagaatccttttggtggtaaatggtgtcagcttcatgaggttgtgttatatgagagtgtttaagagggtgggctccaaatttagactgtctgggttcaaatcctgtcacaagtataatcttggataagtcttattaacctttctaaacaccggttttctcattgataaaccaggggtgataataccaccccccgatagggttgcaagtaaatgagagaatccatgtgaatcacttcaactgaatgatgcctgtggagacctgatacatggcagcactaattttaa

SEQ ID NO: 428312 - DNA, 206 bp, Homo sapiens
ccatgcagcagtgaaccttgtggcttctcttcaaatgggctaagtatggttccctccacatgtgtattcctttcaaagacggtttggtcaggattggggggaaaattttaatagaaggagagtaaattattgaagaatgggaatgataatatgaaattttatttagtgactaatagtgaaaaattgatggttatttcacgttgaat

SEQ ID NO: 428313 - DNA, 3232 bp, Homo sapiens
gaagtgcagcacagaaagggggtccgtgggggacagtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttaaaaaaaa

SEQ ID NO: 428314 - DNA, 3178 bp, Homo sapiens
gaagtgcagcacagaaagggggtccgtgggggacagtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttaaaaaaaa

SEQ ID NO: 428315 - DNA, 3521 bp, Homo sapiens
gcaccaggcgcccagtggagccgtttgggagaattgcctgcgccacgcagcggggccggacaggcggtaaggatctgattaggctttcgaacttgagtttgactgatgtcttctgtgtggtgtccgctaaatcccacagcatataggatcagtcgcattggttataaggtttgcttctggctgggtgcggtggctcatgcctgtaatccaacattgggaggccaaggcaggcggaccacctgaagtcgggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagtggggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttaaaaaaaa

SEQ ID NO: 428316 - DNA, 2730 bp, Homo sapiens
gaagtgcagcacagaaagggggtccgtgggggacagtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattattggcataaacccgggactaatggctgcttacaaagggcatcattaccctggacctggaaaccatttttggaagtgtttgtttatgtcagggctcagtgaggtccagctgaaccatatggatgatcacactctaccagggaagtatggtattggatttaccaacatggtggaaaggaccacgcccggcagcaaagatctctccagtaaagaatttcgtgaaggaggacgtattctagtacagaaattacagaaatatcagccacgaatagcagtgtttaatggaaaatgtatttatgaaatttttagtaaagaagtttttggagtaaaggttaagaacttggaatttgggcttcagccccataagattccagacacagaaactctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaagaggatgcaaagaagatggctgttaaggaagaaaaatatgatccaggttatgaggcagcatatggtggtgcttacggagaaaatccatgcagcagtgaaccttgtggcttctcttcaaatgggctaattgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgtgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaataatattgaaagattttaaaattcatttgaaagtctgatggcttttacaataaaagatattaagaattgttatccttaacttaaaaaaaa

SEQ ID NO: 428317 - DNA, 889 bp, Homo sapiens
ccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttt

SEQ ID NO: 428318 - DNA, 812 bp, Homo sapiens
ccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttt

SEQ ID NO: 428319 - DNA, 897 bp, Homo sapiens
taggatttctcgatggttacttgaaagcgtgtaaaacaacaagacgcattctttgagcgcctacgggatgcgttagaaactgaggaccgaccaaaattaactatgtgtagactttgaacagtttgcagtttgttgaggatcacagggaaaggagctggagagaaacatacactatacttattatggctgtcaaaggacgtgtacgcagtttatatgggtggcttgaatgggtagggagcctaaagttaaggagtagtgttaatcaagacatattgaaaagatgaactaaagcatgctgtcagaggacaataagggaaagctaatgtggaatactggtgtctaggtaagggaatattaaagttggtttcttttttatttgttagatgtaactttttcatctctaatttgtctcactattcattgaaactaagcttaatttctgtgtgcagcctacagtatttctgggtgaggaccaaatagtgaggtccacatccacttaatatatttgccaaccattaaattgccgctaaagctgcagttgggaatctgccctgtttaatatttcagtagagtggtatttgcttagcccaaaaaccatgttgtcaattacaaaaatgctttatgtgagactggggccacactaataagtattgagcatcttttaaatgctgtggcaccgtgagagatgcagaacgaaatcactacccacagagcttttgcaggttagttgaatttaggtattatgcaaaatttctgaaaccagacttctcatcatccttttttttttaaacaatttcctctctctgctttgccctgtctcctcacccacccacaccattccaatcagttggcaagagcccagatgtgtaattttccatatatcctttttgtgaagac

SEQ ID NO: 428320 - DNA, 389 bp, Homo sapiens
ggagaagcatagtctgctttagttatattgttatgccatattatggtcagtaacacagtaaaggcctaattcatctgctttctaaattggttctgtacttttctagaaaagcctacatgtatatacttagttacagctgcacttctccattacttatttttaggaaggttatagagatggaatagatgctggcaaagcagttactcttcaacagggcttcaatcaaggttataagaaaggtgcagaagtcattttaaactatggacgactccgaggaacattgaggtaatttttaaagtctaaatgctgaatcattttaacctcaatactactggaggatgtttctgtataaataaagtgtttaaactgaaatgcttttcctggtgcta

SEQ ID NO: 428321 - DNA, 996 bp, Homo sapiens
ccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaataataattcaactttgatcaataaaataaacaatcttctggatgcagttggccagtgtgaagagtatgtgctcaaacatctgaaatcaatcactccaccgtccctgttgtagatttattgactccattgagtatccc

SEQ ID NO: 428322 - DNA, 906 bp, Homo sapiens
gctcttcaggtgattctaatgtgcatccatgattgagaattgctagttaagaagctgtttaatgtccttaaagaagaaactaatttttctttctcggagttgtattcatcttcaacagatattacatagtcataagagaaaaatataaaatcaggaaaagcgtatatagagttatgaaagaggggttatgaattataaacagttttatgattaagtccaatcgtttaattgttattgaaagatagtcttatatttttaagtcctattttgctatttaacccttgtttatacttttgttcagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttt

SEQ ID NO: 428323 - DNA, 835 bp, Homo sapiens
ccggtggcctgcgaccccgtaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataatctgaaatcaatcactccaccgtcccatgttgtagatttattggactccattgaggatatggacctttgtcatgtagttccagctgagaaaaagattgatgaagctaaagatgaaagactctgtgaaaataatgctgagtttaacaaaaactgtagcaagagccatagtgggatagattgttcatatgtagaatgttgtagaacacaggagcatgcacattcagaaaacccaagccccacatggattttggaacagacagccagtttagttaaacagctgggcctatcagtagatgtattacaacacctcaaacaactataaaattaccttcccttttctaatgaaaataatgttcagaacatttggtttcctaacaatcgaaatttgtactggtttctgcatcaaacacctcaactgtagggttaccctttatggaagtttgaaattaacactattgtcttcaaaattaacactattaaatgtaatataagccttt

SEQ ID NO: 428324 - DNA, 4061 bp, Homo sapiens
  misc_feature (687)..(687): n is a, c, g, or t
  misc_feature (689)..(690): n is a, c, g, or t
  misc_feature (696)..(696): n is a, c, g, or t
  misc_feature (846)..(846): n is a, c, g, or t
gagcgcagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcaaaaaatgaccacagcggtgtaaagaaagccaaatcaaggacccgaatgtgagcaggacctcagaagccccctttgtcactgcctcccagcaaaggcagcactatccggacttctaacaccatcggtgagtttcataccttggcagatggcctttaacatttttgtttaattcaattattcttactaatcttcttctttttcttggctgtggtgcatggctgtggagctcagggtggactcctgttgggcagccagttcctggatggctgtctgtgggtggaggactcctgcctttcctgtttagacacccacaaaggctgctctttagcctccttcccttcatccccttcccctgcccccagtgcaacgagtattacacaaccaacaaaaccgcaaaatattcccacaattttctggtcctctctgggagaggccgctctggcttttcctctcagccctggccctctgcctgctcctcactcctggttggtgctggtcaggctgactagaggccaaggcnanncacagngggccagcgctcagacataaatgccctcttcatttcacgtgtaacattcttttaaaatctaggtcttggttttgttgattttttcttaaataaaagagtgatcataaaagagggacagcatagaaagtccccaaagagcagcaaggtttnaaagaaattcacaagcctaatctgtcactgtcttataatttgctattaccagtcacaatttaactaggttttgtgttgaaaacttgttttggtttgcttctgtcccaagaggcactagctggggcccctacagagtgcagggcagagcttcatttttcgtttgaatgttctagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428325 - DNA, 3237 bp, Homo sapiens
gagcgcagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcaaaaaatgaccacagcggtgtaaagaaagccaaatcaaggacccgaatgtgagcaggacctcagaagccccctttgtcactgcctcccagcaaaggcagcactatccggacttctaacaccatcgggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428326 - DNA, 390 bp, Homo sapiens
  misc_feature (95)..(95): n is a, c, g, or t
tttcgtacgatcgagctcggtaccagcggaacaagcaactagtcggtgcactttgaggctgaggccagaactgggccgaaagcactacaaaggcnatagtgggcttctggaaaaatgcagtaattgtctggtggtcagcattgttggaagatagctaatccgcctgtacttaggcatggttttaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctgttccgctggtaccgagctcgat

SEQ ID NO: 428327 - DNA, 821 bp, Homo sapiens
ctgggtggatacggaagtgcttagggccagcctgatgaggctcctttctcccttccaggatgaccattgatgccggatgctcactccacatgctcagatttccaatggattctcactcttgccctctatctttctctagctgtgagtaccttcttaagtttctggggccccagaaacatgctgggctccttctttttctcatccttgccatttacatttttctgcctctgcttttcttctaaaatgctgccaaggttgtgcaggacttccatcctccaccctcatttcctttcctgccaacaatactgtgttgctcatcccttccacgtgcctctgaagcgtatctcaagtatgtctgctcctctccatctccactggcactaccttggtttaggcctttgttatcttccacctggacttttgccacatcttcactttgaaactgcacatgtccaaaatgaaattcattgtctcctccaaacctctaccaccaaaacaagtgtgttgcttctgggttcccatctgtctcattgaagaggaccatcactcacccagttgcgcaaatcaagaactttgatgttccctctccctcacctcctgcatctaatcaatcagcacatcctgttggtgtttcctcccagtctctatcgatgctgtctatttctctgcaccctgtacagctttgacttccacctgcgttaatttaattctgcctggattactacactggcctccttgacaacatgttgtcctcacagaaggaccagagtgacctagctgaagggtcacctaggttgggtcacttcttagtctcgaatctg

SEQ ID NO: 428328 - DNA, 499 bp, Homo sapiens
  misc_feature (492)..(494): n is a, c, g, or t
  misc_feature (496)..(499): n is a, c, g, or t
ccatgaaagaataaataaagaaataggattagatgctgaaactgtgtggtccaacacttacttgactcccctttcatcccctctgaccacttcctcccccgtcccatgcgcctgtttgacacttaccctctgctgcttctgcttcccttatagagaagcccactgtggtcactgttgagatctccgtcaacagccttggtcctctctctatcctagacatggtgagtactaagcttttttagtactatttcctagcccaggggctgacctatgggaccttccacagacttctgctttctgctctgtacttctgtaacaactccaataatttattttctggagggagaaagggattttttaaccactggtttgagaatgagactggaaaaggtaagtcccttgctacttgaagaggatcttcagaatcatgaccatatcttccagttttttcattcaaaatagaaataataaagcaatgttaaacaccacaannnannnn

SEQ ID NO: 428329 - DNA, 6175 bp, Homo sapiens
gtcttataattgctaagcacttacaactgtttgcagaggaaactgagactttgtaactatgtctcagtctcatctgcaaagaagtaagtgctttgccaagctccttgagaggttaggtaagtagataaagttctgctgctgtcggaatgtgcagctggctttttcatgcagacccttcagtttcgaggttacaactctgacctctttggatgactttggggaatggagctcgtgtgagttctccatacccagaaccaatccagtctggttgaatgggaagcaaagtccattgtagtgggaggtggaggctagagttctaatgtcagctagtttaaggctgggaaagtctggaggaagttacagcagctacactggctgctgcattgacatttatcttaaaggaacaagtctgaaaagcacagattcttatcaaaggcttcatggtggattccacatagacatagtggccactggttttctgaccttttctctgacaaagactaaaggggaaggtcctgggtatcttacacttcagctcccaattagatgtgagcaccttcacttatgttcctaggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccatgtgactaggcagaaaatctgcttttgtttcatttattgagtcagtctctggatgagggaaagctcatgctcatgtggctagagctttgcttgcacagtattaggcaggggcagagggctgggctaccttaaaaatacttgccctttttcttggggactctggggaagcggttttactacctttgacttgggagccttgctcttctgccagctaaccatgggcctgcctcttggttttctgcacctcagcttttcccggataggtggggaccatcatcaaaagtgacagagaagataaggcccagggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaatcttcgtgcaacaagaatatattatataaacccagcaattttgcagggcctgggtataactaattagaagtgtcttaaattgcagtcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaaggtgagtacgaaaggctgctcttctcattcagctccagcccacccagacctgctgggcagttgatccactttccaaaataggaggacacacggacaggttagtgttctggtctgctttacaaagctgttgcctgacaggagcaagagttgctgagtgtctgctgggttccaggctgttctgagcttggatgggcaggggctaagccacagggcctgcatgagccctgccttgaagggacttaaaagacgacctaattataggcctaggaattttacagtattgcaactgcaatgtgatgctgaaagtggaaaatgatgtcctgggctcagagaaaagcccacaccagcctgggagtcatgatagcagcagagtgcttggggagggtgtgtcagagcataaagcagcatgaatgctacaaaagaagatgccaactagagatataggttgtcatcaggtcccggaggagccatgaccgtctagctgagagccatgaccaaggacacaatgtccaagtgactgtgaggacctcagtctgccctgtggatgtgtatgccacagacctgacttctggagggctgactgaaatgttcattttaagctttttcttctctttccctgaaacactcagtttgggttaggggtcatagactaagaccaaagagtccagggttagaatcttggtgtaaaattgcaggccatctcaggaaatctgtgagcagatgggattggctttgggtaaggtgcgtgtggaaaatgtcagtgggagccgggtcatggtgggcctttagcatcagattccagagtgcagatagtctgtatagctcatgtgaaacagggagccaccaaaactttggggagcaggctagtgccggttttgaccacctgtggagcagtgctcactcacgaaggcattttgccatcacatgaatgtgcagaaaggaggccaaaagcattctgtgcttctccaccacagcacagacttccctagtctcatttgctgagagtagacattctgagggccagcagtgcaggtgtgatgtgcctcagagggtatgaagcccttagtcagccatctggatatcagctgcgtgggcatgatatctagaaggctaattgattttttcactttcacctgactctcttgccaacctgcagagacagacattgggtgtaggacagtgaactgagaaggaagctattaagattctggccttggcttagctctcaactggccattggtcttgcagtaagtcttttttctgggcttcttctggtcctatttgtatgtattgcattgtcacatcatgcctctatcctagggaatactgtgagctgaaaaatgagacccttactgttcacgtcctgctaagggggaccgtcgtgtcagcactgtaatgcagtgatgttttttgtgtctttcaggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428330 - DNA, 4849 bp, Homo sapiens
gtcttataattgctaagcacttacaactgtttgcagaggaaactgagactttgtaactatgtctcagtctcatctgcaaagaagtaagtgctttgccaagctccttgagaggttaggtaagtagataaagttctgctgctgtcggaatgtgcagctggctttttcatgcagacccttcagtttcgaggttacaactctgacctctttggatgactttggggaatggagctcgtgtgagttctccatacccagaaccaatccagtctggttgaatgggaagcaaagtccattgtagtgggaggtggaggctagagttctaatgtcagctagtttaaggctgggaaagtctggaggaagttacagcagctacactggctgctgcattgacatttatcttaaaggaacaagtctgaaaagcacagattcttatcaaaggcttcatggtggattccacatagacatagtggccactggttttctgaccttttctctgacaaagactaaaggggaaggtcctgggtatcttacacttcagctcccaattagatgtgagcaccttcacttatgttcctaggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccatgtgactaggcagaaaatctgcttttgtttcatttattgagtcagtctctggatgagggaaagctcatgctcatgtggctagagctttgcttgcacagtattaggcaggggcagagggctgggctaccttaaaaatacttgccctttttcttggggactctggggaagcggttttactacctttgacttgggagccttgctcttctgccagctaaccatgggcctgcctcttggttttctgcacctcagcttttcccggataggtggggaccatcatcaaaagtgacagagaagataaggcccagggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaatcttcgtgcaacaagaatatattatataaacccagcaattttgcagggcctgggtataactaattagaagtgtcttaaattgcagtcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaaggtgagtacgaaaggctgctcttctcattcagctccagcccacccagacctgctgggcagttgatccactttccaaaataggaggacacacggacaggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428331 - DNA, 1417 bp, Homo sapiens
cggaggactgtgtcccaagtcgggtctcttgctgccccccctcttcctaaagggataatgccagtgtctatctatctgcagagaaaggggtagcagggagagagaactgagaacataataatctgaccaaaggagagggatcttaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428332 - DNA, 1393 bp, Homo sapiens
cagagtccaaacagtgcccagagtccaaacagggcccaaagtccaaacagtgcccagagtccaaacagtgcccagaggccaaacagtgcccagagtccaaacagtgcccagagtccaaataaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428333 - DNA, 1258 bp, Homo sapiens
  misc_feature (95)..(95): n is a, c, g, or t
tttcgtacgatcgagctcggtaccagcggaacaagcaactagtcggtgcactttgaggctgaggccagaactgggccgaaagcactacaaaggcnatagtgggcttctggaaaaatgcagtaattgtctggtggtcagcattgttggaagatagctaatccgcctgtacttaggcatggttttaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428334 - DNA, 5161 bp, Homo sapiens
gtcttataattgctaagcacttacaactgtttgcagaggaaactgagactttgtaactatgtctcagtctcatctgcaaagaagtaagtgctttgccaagctccttgagaggttaggtaagtagataaagttctgctgctgtcggaatgtgcagctggctttttcatgcagacccttcagtttcgaggttacaactctgacctctttggatgactttggggaatggagctcgtgtgagttctccatacccagaaccaatccagtctggttgaatgggaagcaaagtccattgtagtgggaggtggaggctagagttctaatgtcagctagtttaaggctgggaaagtctggaggaagttacagcagctacactggctgctgcattgacatttatcttaaaggaacaagtctgaaaagcacagattcttatcaaaggcttcatggtggattccacatagacatagtggccactggttttctgaccttttctctgacaaagactaaaggggaaggtcctgggtatcttacacttcagctcccaattagatgtgagcaccttcacttatgttcctaggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccatgtgactaggcagaaaatctgcttttgtttcatttattgagtcagtctctggatgagggaaagctcatgctcatgtggctagagctttgcttgcacagtattaggcaggggcagagggctgggctaccttaaaaatacttgccctttttcttggggactctggggaagcggttttactacctttgacttgggagccttgctcttctgccagctaaccatgggcctgcctcttggttttctgcacctcagcttttcccggataggtggggaccatcatcaaaagtgacagagaagataaggcccagggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaatcttcgtgcaacaagaatatattatataaacccagcaattttgcagggcctgggtataactaattagaagtgtcttaaattgcagtcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaaggtgagtacgaaaggctgctcttctcattcagctccagcccacccagacctgctgggcagttgatccactttccaaaataggaggacacacggacaggttagtgttctggtctgctttacaaagctgttgcctgacaggagcaagagttgctgagtgtctgctgggttccaggctgttctgagcttggatgggcaggggctaagccacagggcctgcatgagccctgccttgaagggacttaaaagacgacctaattataggcctaggaattttacagtattgcaactgcaatgtgatgctgaaagtggaaaatgatgtcctgggctcagagaaaagcccacaccagcctgggagtcatgatagcagcagagtgcttggggagggtgtgtcagagcataaagcagcatgaatgctacaaaagaagatgccaactagagatataggttgtcatcaggtcccggaggagccatgaccgtctagctgagagccatgaccaaggacacaatgtccaagtgactgtgaggacctcagtctgccctgtggatgtgtatgccacagacctgacttctggagggctgactgaaatgttcattttaagctttttcttctctttccctgaaacactcagtttgggttaggggtcatagactaagaccaaagagtccagggttagaatcttggtgtaaaattgcaggccatctcaggaaatctgtgagcagatgggattggctttgggtaaggtgcgtgtggaaaatgtcagtgggagccgggtcatggtgggcctttagcatcagattccagagtgcagatagtctgtatagctcatgtgaaacagggagccaccaaaactttggggagcaggctagtgccggttttgaccacctgtggagcagtgctcactcacgaaggcattttgccatcacatgaatgtgcagaaaggaggccaaaagcattctgtgcttctccaccacagcacagacttccctagtctcatttgctgagagtagacattctgagggccagcagtgcaggtgtgatgtgcctcagagggtatgaagcccttagtcagccatctggatatcagctgcgtgggcatgatatctagaaggctaattgattttttcactttcacctgactctcttgccaacctgcagagacagacattgggtgtaggacagtgaactgagaaggaagctattaagattctggccttggcttagctctcaactggccattggtcttgcagtaagtcttttttctgggcttcttctggtcctatttgtatgtattgcattgtcacatcatgcctctatcctagggaatactgtgagctgaaaaatgagacccttactgttcacgtcctgctaagggggaccgtcgtgtcagcactgtaatgcagtgatgttttttgtgtctttcaggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtaatatggcggataaagagcttttgtcctggtagctgaaacttttcattaatttgtccaagaatactgtgccggtgggttagagtccgcagaacagacaagtagagactctcctgaacggtaataggtggtgcatcgataacaccggtacgagctcatcc

SEQ ID NO: 428335 - DNA, 4204 bp, Homo sapiens
gtcttataattgctaagcacttacaactgtttgcagaggaaactgagactttgtaactatgtctcagtctcatctgcaaagaagtaagtgctttgccaagctccttgagaggttaggtaagtagataaagttctgctgctgtcggaatgtgcagctggctttttcatgcagacccttcagtttcgaggttacaactctgacctctttggatgactttggggaatggagctcgtgtgagttctccatacccagaaccaatccagtctggttgaatgggaagcaaagtccattgtagtgggaggtggaggctagagttctaatgtcagctagtttaaggctgggaaagtctggaggaagttacagcagctacactggctgctgcattgacatttatcttaaaggaacaagtctgaaaagcacagattcttatcaaaggcttcatggtggattccacatagacatagtggccactggttttctgaccttttctctgacaaagactaaaggggaaggtcctgggtatcttacacttcagctcccaattagatgtgagcaccttcacttatgttcctaggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccatgtgactaggcagaaaatctgcttttgtttcatttattgagtcagtctctggatgagggaaagctcatgctcatgtggctagagctttgcttgcacagtattaggcaggggcagagggctgggctaccttaaaaatacttgccctttttcttggggactctggggaagcggttttactacctttgacttgggagccttgctcttctgccagctaaccatgggcctgcctcttggttttctgcacctcagcttttcccggataggtggggaccatcatcaaaagtgacagagaagataaggcccagggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaatcttcgtgcaacaagaatatattatataaacccagcaattttgcagggcctgggtataactaattagaagtgtcttaaattgcagtcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaaggtgagtacgaaaggctgctcttctcattcagctccagcccacccagacctgctgggcagttgatccactttccaaaataggaggacacacggacaggttagtgttctggtctgctttacaaagctgttgcctgacaggagcaagagttgctgagtgtctgctgggttccaggctgttctgagcttggatgggcaggggctaagccacagggcctgcatgagccctgccttgaagggacttaaaagacgacctaattataggcctaggaattttacagtattgcaactgcaatgtgatgctgaaagtggaaaatgatgtcctgggctcagagaaaagcccacaccagcctgggagtcatgatagcagcagagtgcttggggagggtgtgtcagagcataaagcagcatgaatgctacaaaagaagatgccaactagagatataggttgtcatcaggtcccggaggagccatgaccgtctagctgagagccatgaccaaggacacaatgtccaagtgactgtgaggacctcagtctgccctgtggatgtgtatgccacagacctgacttctggagggctgactgaaatgttcattttaagctttttcttctctttccctgaaacactcagtttgggttaggggtcatagactaagaccaaagagtccagggttagaatcttggtgtaaaattgcaggccatctcaggaaatctgtgagcagatgggattggctttgggtaaggtgcgtgtggaaaatgtcagtgggagccgggtcatggtgggcctttagcatcagattccagagtgcagatagtctgtatagctcatgtgaaacagggagccaccaaaactttggggagcaggctagtgccggttttgaccacctgtggagcagtgctcactcacgaaggcattttgccatcacatgaatgtgcagaaaggaggccaaaagcattctgtgcttctccaccacagcacagacttccctagtctcatttgctgagagtagacattctgagggccagcagtgcaggtgtgatgtgcctcagagggtatgaagcccttagtcagccatctggatatcagctgcgtgggcatgatatctagaaggctaattgattttttcactttcacctgactctcttgccaacctgcagagacagacattgggtgtaggacagtgaactgagaaggaagctattaagattctggccttggcttagctctcaactggccattggtcttgcagtaagtcttttttctgggcttcttctggtcctatttgtatgtattgcattgtcacatcatgcctctatcctagggaatactgtgagctgaaaaatgagacccttactgttcacgtcctgctaagggggaccgtcgtgtcagcactgtaatgcagtgatgttttttgtgtctttcaggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacgaatcctgggatcctctagatcaccatcc

SEQ ID NO: 428336 - DNA, 1583 bp, Homo sapiens
  misc_feature (687)..(687): n is a, c, g, or t
  misc_feature (689)..(690): n is a, c, g, or t
  misc_feature (696)..(696): n is a, c, g, or t
  misc_feature (846)..(846): n is a, c, g, or t
  misc_feature (1576)..(1578): n is a, c, g, or t
  misc_feature (1580)..(1583): n is a, c, g, or t
gagcgcagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcaaaaaatgaccacagcggtgtaaagaaagccaaatcaaggacccgaatgtgagcaggacctcagaagccccctttgtcactgcctcccagcaaaggcagcactatccggacttctaacaccatcggtgagtttcataccttggcagatggcctttaacatttttgtttaattcaattattcttactaatcttcttctttttcttggctgtggtgcatggctgtggagctcagggtggactcctgttgggcagccagttcctggatggctgtctgtgggtggaggactcctgcctttcctgtttagacacccacaaaggctgctctttagcctccttcccttcatccccttcccctgcccccagtgcaacgagtattacacaaccaacaaaaccgcaaaatattcccacaattttctggtcctctctgggagaggccgctctggcttttcctctcagccctggccctctgcctgctcctcactcctggttggtgctggtcaggctgactagaggccaaggcnanncacagngggccagcgctcagacataaatgccctcttcatttcacgtgtaacattcttttaaaatctaggtcttggttttgttgattttttcttaaataaaagagtgatcataaaagagggacagcatagaaagtccccaaagagcagcaaggtttnaaagaaattcacaagcctaatctgtcactgtcttataatttgctattaccagtcacaatttaactaggttttgtgttgaaaacttgttttggtttgcttctgtcccaagaggcactagctggggcccctacagagtgcagggcagagcttcatttttcgtttgaatgttctagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggtgagtactaagcttttttagtactatttcctagcccaggggctgacctatgggaccttccacagacttctgctttctgctctgtacttctgtaacaactccaataatttattttctggagggagaaagggattttttaaccactggtttgagaatgagactggaaaaggtaagtcccttgctacttgaagaggatcttcagaatcatgaccatatcttccagttttttcattcaaaatagaaataataaagcaatgttaaacaccacaannnannnn

SEQ ID NO: 428337 - DNA, 396 bp, Homo sapiens
caaggtgttgtacacaattaggtatgtcaagcctctggagtctcacttcctggaattctctctccccttctgataattttagctaaagatccatgggcagagatctcatcctgaatgatacctctaagggcctgtccagctttcctagaccatgagctcagcccccttatgtaacagatatagaggcctcaaaatagaaagatattgcttaaagccacacaccaagtttgtggcagagctggaactggtactcagttacttggctccgagtccagagctccctcaactaggatgtgccagtatgactgcattatctagacaattccatcctaagtgggcactcgatacaaagatacgtccacagtggtggaattgttcaggcagagcagcagcacg

SEQ ID NO: 428338 - DNA, 3155 bp, Homo sapiens
gagcgcagagcgtgagccgcgacctccgcgcaggtggtcgcgccggtctccgcggaaatgttgtccaaagttcttccagtcctcctaggcatcttattgatcctccagtcgagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428339 - DNA, 3333 bp, Homo sapiens
gagcgcagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcaaaaaatgaccacagcggtgtaaagaaagccaaatcaaggacccgaatgtgagcaggacctcagaagccccctttgtcactgcctcccagcaaaggcagcactatccggacttctaacaccatcgggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagcttttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428340 - DNA, 547 bp, Homo sapiens
taccccccttcctgcagccgctgctgacgtccccccgccacagcaggtcggggaccacttgcctttttagcccttcctctccctctcctctccatctccactggcactaccttggtttaggcctttgttatcttccacctggacttttgccacatcttcactttgaaactgcacatgtccaaaatgaaattcattgtctcctccaaacctctaccaccaaaacaagtgtgttgcttctgggttcccatctgtctcattgaagaggaccatcactcacccagttgcgcaaatcaagaactttgatgttccctctccctcacctcctgcatctaatcaatcagcacatcctgttggtgtttcctcccagtctctatcgatgctgtctatttctctgcaccctgtacagctttgacttccacctgcgttaatttaattctgcctggattactacactggcctccttgacaacatgttgtcctcacagaaggaccagagtgacctagctgaagggtcacctaggttgggtcacttcttagtctcgaatctg

SEQ ID NO: 428341 - DNA, 5999 bp, Homo sapiens
gtcttataattgctaagcacttacaactgtttgcagaggaaactgagactttgtaactatgtctcagtctcatctgcaaagaagtaagtgctttgccaagctccttgagaggttaggtaagtagataaagttctgctgctgtcggaatgtgcagctggctttttcatgcagacccttcagtttcgaggttacaactctgacctctttggatgactttggggaatggagctcgtgtgagttctccatacccagaaccaatccagtctggttgaatgggaagcaaagtccattgtagtgggaggtggaggctagagttctaatgtcagctagtttaaggctgggaaagtctggaggaagttacagcagctacactggctgctgcattgacatttatcttaaaggaacaagtctgaaaagcacagattcttatcaaaggcttcatggtggattccacatagacatagtggccactggttttctgaccttttctctgacaaagactaaaggggaaggtcctgggtatcttacacttcagctcccaattagatgtgagcaccttcacttatgttcctaggtgacctgaatgaggagccaagggacctccccagggtagctcccagagcaaccctggaaacactcttcacacatcctgaccaagttcagggcagtgaaggcactgccctcatcgtttccagaatgtggatggagccagtcacccaaccagccatttgtcgtgagaggcatcttgttctgctaccatgtgactaggcagaaaatctgcttttgtttcatttattgagtcagtctctggatgagggaaagctcatgctcatgtggctagagctttgcttgcacagtattaggcaggggcagagggctgggctaccttaaaaatacttgccctttttcttggggactctggggaagcggttttactacctttgacttgggagccttgctcttctgccagctaaccatgggcctgcctcttggttttctgcacctcagcttttcccggataggtggggaccatcatcaaaagtgacagagaagataaggcccagggctttcaagtcactagtggttccgtttagtagatgattgtgcattgtttcaaaatggtgccctagtgactacaaagccccagagccagcatcatcatcaaagcaatgacagtaggtaagcaccagacctccttgggagtgaggaggattcttgaggagaaaagaggtcttctttctcctctgctggagactagttgatctggagacgtggttccttcaatgtcagagttatctttgggactggtctcaaactcttccagttgggccctggggcaggtctctccatctggagcatacttacgtgctcggcgattaagggttcagaatgcagtggtagcctgctactctggccatcttggaccttgatccagagaatctctgcttcaggagcttctaagagagtccagccctgcctccagagagaggcttgcccttcactgatggctgtggagcctctgatggaatattattgctggtcaggaattcactgtcttacaaggaggtttccttcttctctagacagttctgttcatcaaaaaactctccctgttcttctgaaattggagtctctggaagttccacacattaagcttagttctttttccttggaactgtccaggttacattagtccagccactgtttcacaggaccgagattaaacgatcaacatcatcattcccggcatggatcatagtctgttgtagtctacatagccctagtttatttttcttcccttattcttcaaagctttgggtccattcattcttctagtcccagtcctctggacatggtctatttaattgtgtccctctgacactgcagtgaccaaccatgatctggtcaaagaggataagagtttgagcagaaaaccatctttagcatatatttttttgctttggttcatcagccccagatatattgttttccttacccgtgcttctctcactcctcaagaagaagaaagtgtgtgttagcatctttctcttgtccttcaagacaaattggcatctcttgacgagcggagaaggttcttttttggccagaataaataaaattaaaatagaatcatccaacagaataataaatcttcgtgcaacaagaatatattatataaacccagcaattttgcagggcctgggtataactaattagaagtgtcttaaattgcagtcaagatcccacggcaagaggacttttgataaatacattctggccagtaggcaagtgcgagggtggtccgtgcagcagctctggaggagttctatcccaaagctatactcaacacacaggtttcccactgacaacaggtcgctcccttgccttcttccagaagaatctgagaagctttgctccttgagtttcagtgctgccaaggtgagtacgaaaggctgctcttctcattcagctccagcccacccagacctgctgggcagttgatccactttccaaaataggaggacacacggacaggttagtgttctggtctgctttacaaagctgttgcctgacaggagcaagagttgctgagtgtctgctgggttccaggctgttctgagcttggatgggcaggggctaagccacagggcctgcatgagccctgccttgaagggacttaaaagacgacctaattataggcctaggaattttacagtattgcaactgcaatgtgatgctgaaagtggaaaatgatgtcctgggctcagagaaaagcccacaccagcctgggagtcatgatagcagcagagtgcttggggagggtgtgtcagagcataaagcagcatgaatgctacaaaagaagatgccaactagagatataggttgtcatcaggtcccggaggagccatgaccgtctagctgagagccatgaccaaggacacaatgtccaagtgactgtgaggacctcagtctgccctgtggatgtgtatgccacagacctgacttctggagggctgactgaaatgttcattttaagctttttcttctctttccctgaaacactcagtttgggttaggggtcatagactaagaccaaagagtccagggttagaatcttggtgtaaaattgcaggccatctcaggaaatctgtgagcagatgggattggctttgggtaaggtgcgtgtggaaaatgtcagtgggagccgggtcatggtgggcctttagcatcagattccagagtgcagatagtctgtatagctcatgtgaaacagggagccaccaaaactttggggagcaggctagtgccggttttgaccacctgtggagcagtgctcactcacgaaggcattttgccatcacatgaatgtgcagaaaggaggccaaaagcattctgtgcttctccaccacagcacagacttccctagtctcatttgctgagagtagacattctgagggccagcagtgcaggtgtgatgtgcctcagagggtatgaagcccttagtcagccatctggatatcagctgcgtgggcatgatatctagaaggctaattgattttttcactttcacctgactctcttgccaacctgcagagacagacattgggtgtaggacagtgaactgagaaggaagctattaagattctggccttggcttagctctcaactggccattggtcttgcagtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428342 - DNA, 3978 bp, Homo sapiens
  misc_feature (687)..(687): n is a, c, g, or t
  misc_feature (689)..(690): n is a, c, g, or t
  misc_feature (696)..(696): n is a, c, g, or t
  misc_feature (846)..(846): n is a, c, g, or t
gagcgcagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcaaaaaatgaccacagcggtgtaaagaaagccaaatcaaggacccgaatgtgagcaggacctcagaagccccctttgtcactgcctcccagcaaaggcagcactatccggacttctaacaccatcggtgagtttcataccttggcagatggcctttaacatttttgtttaattcaattattcttactaatcttcttctttttcttggctgtggtgcatggctgtggagctcagggtggactcctgttgggcagccagttcctggatggctgtctgtgggtggaggactcctgcctttcctgtttagacacccacaaaggctgctctttagcctccttcccttcatccccttcccctgcccccagtgcaacgagtattacacaaccaacaaaaccgcaaaatattcccacaattttctggtcctctctgggagaggccgctctggcttttcctctcagccctggccctctgcctgctcctcactcctggttggtgctggtcaggctgactagaggccaaggcnanncacagngggccagcgctcagacataaatgccctcttcatttcacgtgtaacattcttttaaaatctaggtcttggttttgttgattttttcttaaataaaagagtgatcataaaagagggacagcatagaaagtccccaaagagcagcaaggtttnaaagaaattcacaagcctaatctgtcactgtcttataatttgctattaccagtcacaatttaactaggttttgtgttgaaaacttgttttggtttgcttctgtcccaagaggcactagctggggcccctacagagtgcagggcagagcttcatttttcgtttgaatgttctagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattagtttcctatcctgagaatgagatgatctacaagtgggaaaatttcaagcttgaaatcaatgagaagaactcctggaagctcttccagtttgattttacaggagtgagcaacaaaactgaaataatcacaaccccagttggtgacttcatggtcatgacgattttcttcaatgtgagcaggcggtttggctatgttgcctttcaaaactatgtcccttcttccgtgaccacgatgctctcctgggtttccttttggatcaagacagagtctgctccagcccggacctctctagggatcacctctgttctgaccatgaccacgttgggcaccttttctcgtaagaatttcccgcgtgtctcctatatcacagccttggatttctatatcgccatctgcttcgtcttctgcttctgcgctctgttggagtttgctgtgctcaacttcctgatctacaaccagacaaaagcccatgcttctcctaaactccgccatcctcgtatcaatagccgtgcccatgcccgtacccgtgcacgttcccgagcctgtgcccgccaacatcaggaagcttttgtgtgccagattgtcaccactgagggaagtgatggagaggagcgcccgtcttgctcagcccagcagccccctagcccaggtagccctgagggtccccgcagcctctgctccaagctggcctgctgtgagtggtgcaagcgttttaagaagtacttctgcatggtccccgattgtgagggcagtacctggcagcagggccgcctctgcatccatgtctaccgcctggataactactcgagagttgttttcccagtgactttcttcttcttcaatgtgctctactggcttgtttgccttaacttgtaggtaccagctggtaccctgtggggcaacctctccagttccccaggaggtccaagccccttgccaagggagttgggggaaagcagcagcagcagcaggagcgactagagtttttcctgccccattccccaaacagaagcttgcagagggtttgtctttgctgcccctctcccctacctggcccattcactgagtcttctcagcagaccatttcaaattattaataaatgggccacctccctcttcttcaaggagcatccgtgatgctcagtgttcaaaaccacagccacttagtgatcagctccctaaaaccatgcctaagtacaggcggattagctatcttccaacaatgctgaccaccagacaattactgcatttttccagaagcccactattgcctttgtagtgctttcggcccagttctggcctcagcctcaaagtgcaccgactagttgcttgcctatacctggcacctcattaagatgctgggcagcagtataacaggaggaagagatccctctcctttggtcagattattatgttctcagttctctctccctgctacccctttctctgcagatagatagacactggcattatccctttaggaagaggggggggcagcaagagagcctatttgggacagcattcctctctctctgctgctgtgacatctccctctccttgctggctccatctttcgtctgcactaccaattcaatgcccttcatccaatgggtatctatttttgtgtgtgattatagtaactactccctgctttatatgccaccctcttccttctctttgacccctgtgactctttctgtaactttcccagtgacttcccctagccctgacccaggcactaggccttggtgacttcctggggccaagaaactaaggaaactcggctttgcaacaggcattactcgccattgattggtgcccacccagggcacactgtcggagttctatcacttgcttgacccctggacccataaaccagtccactgttatacccggggcactctaaccatcacaatcaatcaatcaaattcccttaaatttgtatggcactggaactttggcaaagcacttttgacaagttgtgtctgattggagcttcatgatagccttgtgacatctttagggcaggattcttatccccattttgcagatgaaaaccctgagtcacagatttctgtgggactgtggatctcactggaagctatccaagagcccactgtcaccttctagaccacatgatagggctagacagctcagttcaccatgattctcttctgtcacctctgctggcacaccagtggcaaggcccagaatggcgacctctctttagctcaatttctgggcctgaggtgctcagactgcccccaagatcaaatctctcctggctgtagtaacccagtggaatgaatttggacatgccccaatgcttctatatgctaagtgaaatctgtgtctgtaatttgttggggggtggatagggtggggtctccatctactttttgtcaccatcatctgaaatggggaaatatgtaaataaatatatcagcaaagca

SEQ ID NO: 428343 - DNA, 2289 bp, Homo sapiens
  misc_feature (687)..(687): n is a, c, g, or t
  misc_feature (689)..(690): n is a, c, g, or t
  misc_feature (696)..(696): n is a, c, g, or t
  misc_feature (846)..(846): n is a, c, g, or t
gagcgcagagcgtgagccgcgacctccgcgcaggtggtcgcgccggtctccgcggaaatgttgtccaaagttcttccagtcctcctaggcatcttattgatcctccagtcgagaacatgtatacagagaagtgctcaaatcataagtgtacagctgatgagttgtcaaaaaatgaccacagcggtgtaaagaaagccaaatcaaggacccgaatgtgagcaggacctcagaagccccctttgtcactgcctcccagcaaaggcagcactatccggacttctaacaccatcggtgagtttcataccttggcagatggcctttaacatttttgtttaattcaattattcttactaatcttcttctttttcttggctgtggtgcatggctgtggagctcagggtggactcctgttgggcagccagttcctggatggctgtctgtgggtggaggactcctgcctttcctgtttagacacccacaaaggctgctctttagcctccttcccttcatccccttcccctgcccccagtgcaacgagtattacacaaccaacaaaaccgcaaaatattcccacaattttctggtcctctctgggagaggccgctctggcttttcctctcagccctggccctctgcctgctcctcactcctggttggtgctggtcaggctgactagaggccaaggcnanncacagngggccagcgctcagacataaatgccctcttcatttcacgtgtaacattcttttaaaatctaggtcttggttttgttgattttttcttaaataaaagagtgatcataaaagagggacagcatagaaagtccccaaagagcagcaaggtttnaaagaaattcacaagcctaatctgtcactgtcttataatttgctattaccagtcacaatttaactaggttttgtgttgaaaacttgttttggtttgcttctgtcccaagaggcactagctggggcccctacagagtgcagggcagagcttcatttttcgtttgaatgttctagggtcgagggacctcagactgaatcaaagaatgaagcctcttcccgtgatgttgtctatggcccccagccccagcctctggaaaatcagctcctctctgaggaaacaaagtcaactgagactgagactgggagcagagttggcaaactgccagaagcctctcgcatcctgaacactatcctgagtaattatgaccacaaactgcgccctggcattggagagaagcccactgtggtcactgttgagatctccgtcaacagccttggtcctctctctatcctagacatggaatacaccattgacatcatcttctcccagacctggtacgacgaacgcctctgttacaacgacacctttgagtctcttgttctgaatggcaatgtggtgagccagctatggatcccggacaccttttttaggaattctaagaggacccacgagcatgagatcaccatgcccaaccagatggtccgcatctacaaggatggcaaggtgttgtacacaattaggatgaccattgatgccggatgctcactccacatgctcagatttccaatggattctcactcttgccctctatctttctctagctgtgagtaccttcttaagtttctggggccccagaaacatgctgggctccttctttttctcatccttgccatttacatttttctgcctctgcttttcttctaaaatgctgccaaggttgtgcaggacttccatcctccaccctcatttcctttcctgccaacaatactgtgttgctcatcccttccacgtgcctctgaagcgtatctcaagtatgtctgctcctctccatctccactggcactaccttggtttaggcctttgttatcttccacctggacttttgccacatcttcactttgaaactgcacatgtccaaaatgaaattcattgtctcctccaaacctctaccaccaaaacaagtgtgttgcttctgggttcccatctgtctcattgaagaggaccatcactcacccagttgcgcaaatcaagaactttgatgttccctctccctcacctcctgcatctaatcaatcagcacatcctgttggtgtttcctcccagtctctatcgatgctgtctatttctctgcaccctgtacagctttgacttccacctgcgttaatttaattctgcctggattactacactggcctccttgacaacatgttgtcctcacagaaggaccagagtgacctagctgaagggtcacctaggttgggtcacttcttagtctcgaatctg

SEQ ID NO: 428344 - DNA, 2067 bp, Homo sapiens
ggagaaccaccctgatgttcacagtggggtgggcggtaagcaagagtcaagctggtttctccggggaagcgggtgcctatttgaaggcgagtaaagacgtaggagaccgaggaaagtgtgtgggaggcgttgacctgccccttgtcctggccccgccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggccgggcactgctgcggctgaatgcggagaagctgcagcggatggggctggcccaggaggcccagaggcaggaggtgctgcagcaggtgctccgcctgcaggtgcgtgaggaggggcggagcctgcagctgctcagccaagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggcccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatctttgggaaaatcttgcttttatggtcttcccccctcgccctcaagaacaagggccttgtgcgtgggccttcccattgctgctttcccaagaaggcctggattcaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtg

SEQ ID NO: 428345 - DNA, 2009 bp, Homo sapiens
ggccccatgttcaccgagctgaggtccaagctgagccccccgcgtggccgcgccggggccgtgcgcgcgggcttcggggagcgccgggatgtggacgccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggccgggcactgctgcggctgaatgcggagaagctgcagcggatggggctggcccaggaggcccagaggcaggaggtgctgcagcaggtgctccgcctgcaggtgcgtgaggaggggcggagcctgcagctgctcagccaagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggcccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatctttgggaaaatcttgcttttatggtcttcccccctcgccctcaagaacaagggccttgtgcgtgggccttcccattgctgctttcccaagaaggcctggattcaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtg

SEQ ID NO: 428346 - DNA, 2184 bp, Homo sapiens
ggagaaccaccctgatgttcacagtggggtgggcggtaagcaagagtcaagctggtttctccggggaagcgggtgcctatttgaaggcgagtaaagacgtaggagaccgaggaaagtgtgtgggaggcgttgacctgccccttgtcctggccccggctctgttcacttgcagataccatacagagccttcattcattcattcattgacaatgaatgtggggtgcccctctgtaaccagacctggatcaagacgcctgcctccccagactcagccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggccgggcactgctgcggctgaatgcggagaagctgcagcggatggggctggcccaggaggcccagaggcaggaggtgctgcagcaggtgctccgcctgcaggtgcgtgaggaggggcggagcctgcagctgctcagccaagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggcccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatctttgggaaaatcttgcttttatggtcttcccccctcgccctcaagaacaagggccttgtgcgtgggccttcccattgctgctttcccaagaaggcctggattcaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtg

SEQ ID NO: 428347 - DNA, 1743 bp, Homo sapiens
  misc_feature (12)..(12): n is a, c, g, or t
  misc_feature (34)..(34): n is a, c, g, or t
  misc_feature (38)..(38): n is a, c, g, or t
aggctccgcccntcctcacgcacctgcaggcggnaccntgctgcagcacctcctgcctctgggcctcctgggcagccccatccgctgcagcttctccgcattcagccgcagcagtgcccggcctggggagaggaaagaggggcggagcctgcagctgctcagccaaggtcagtgtgaggtgccagagaggcctgggggctgatggagaagcccctctgagtgtggggtgggatgacctcaggaggtcggctgcaggccccagtaagcgccctaatgcagatgatgccaaagaccccaccccattctcaccctcttccatcacacagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggcccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatctttgggaaaatcttgcttttatggtcttcccccctcgccctcaagaacaagggccttgtgcgtgggccttcccattgctgctttcccaagaaggcctggattcaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtg

SEQ ID NO: 428348 - DNA, 2312 bp, Homo sapiens
ggagaaccaccctgatgttcacagtggggtgggcggtaagcaagagtcaagctggtttctccggggaagcgggtgcctatttgaaggcgagtaaagacgtaggagaccgaggaaagtgtgtgggaggcgttgacctgccccttgtcctggccccgccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggccgggcactgctgcggctgaatgcggagaagctgcagcggatggggctggcccaggaggcccagaggcaggaggtgctgcagcaggtgctccgcctgcaggtgcgtgaggaggggcggagcctgcagctgctcagccaagcttccttcgggaaaatgtcctagctgctgctgaggcttgaacccagaccccagcactgtgatgggagtccacggctagggaggaggccaagctggccccgcagcgcctcttggaccctgcgggatgccggggcggccaggctggcccaacggacagacaggaccaggatcacacctccaggcgcctctggttggacattccaggtcgtgccctggggctgggtgggtagggggctgcttgagtgtggcccacctcctgggacctgagcccaagccctcccctggtgcagctggcagcatgtggggcagctgcctggagccagaaccggtttggatgtcccccctagactcccagggagtctgtttatttacattcccctctccacgtgatgtcggtcccccatcgcctgctgagtcacttgtctgtccacccacccagcccagttctaggtcgttccccagcacctccaggttggcccacacaggtaccataagctgcctcggctccctgtggcttgtgcccatgcacctgccagggcccagcaggccaacccatcatctagagtagtggccatcagcacccgcctaacgggcaccatgccaagcactttcatcattatttatacatcgtcaccacaccccctctattcatgagaagtaaagctgagaaaggaccagattgaccaagcgccagagacaaaatgtggcacaacgagaaccccagccctgtccaggtggctccgcgcccagggcccaggcttagcagtgctccctgccctatcttggcgctggtcaatctggtcctttctcagctttacttctcatgaatagagggggtgtggtgacgatgtataaataatgatgaaagtgcttggcatggtgcccgttaggcgggtgctgatggccactactctagatgatgggttggcctgctgggccctggcaggtgcatgggcacaagccacagggagccgaggcagcttatggtacctgtgtgggccaacctggaggtgctggggaacgacctagaactgggctgggtgggtggacagacaagtgactcagcaggcgatgggggaccgacatcacgtggagaggggaatgtaaataaacagactccctgggagtctaggggagaggccttcccagggccactccccttacaccctcccagaggcctgagcaacccctctctgggtggtttggggctggtgctgcctggcggaaggacagtgagggcggccctagccgcctccaccctcttgcgcctctgccctctcccagtccccctgtggcttctgaaaatctcagggacagatgaggctgagcccctagtcccctctgtgtgctttgagcctccagactcgaggctggtcactgcaggtcccaggtggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtg

SEQ ID NO: 428349 - DNA, 772 bp, Homo sapiens
ggaatttggacaactggcctggccgctcccatcctgtaagcccccaccacggggagaccctcatccctgcccctgtgtggctgcgcaagtattctgcccgcctcccaccatcagccttcgcccaaggggcccttctgcctctgcttccctcccttctcctctgtcttgccctggcccacgcacgcctgtctcgtcttccttgttttgctgcactcacttttttatactctgacaaaaaaaaaaaatcagaaataaagctggttcccaagtgctggcggtgctgggtctgcgaggagagggcgtctgggcagccgcggccaccagggggcagtggcgtcacgccctggaggggcgtctgggcaaccccgcgcagaggctggaaacagggctcaagtcacgcctgtgggcggtccccagtgctggacacaacgcccgacacgctggaagggacggcccagacagcgcgtgagggtcccgcggctgccgtgacagaggaccacggaggggtgctgagaacagcagacattcattctctctggagttctggaggccgcagtccaaaatccagctccctcagggcctcctggggcgactcctcacctctccagcttccagtggctgccgggggaactcgggcgcatgggcattacccgtctccgcctctgtaatcagatcacctcctcctcttctgtctctcaaatctccctctgtctctctcttataaggatgcttggatttggggccacctgggtaatacaggataatctcctca

SEQ ID NO: 428350 - DNA, 539 bp, Homo sapiens
  misc_feature (23)..(23): n is a, c, g, or t
ataattaggagtcatcttaaatnaaagaaagttatggtttaaggttgttggctgtaacacaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttaca

SEQ ID NO: 428351 - DNA, 4818 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaaaaaaagtg

SEQ ID NO: 428352 - DNA, 4708 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgaggcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaaaaaaagtg

SEQ ID NO: 428353 - DNA, 3853 bp, Homo sapiens
  misc_feature (44)..(44): n is a, c, g, or t
agtaacatgatacgatcgagctcggacccagtgcgcaacgcgtnctattgtggagaagaccaccacatcctttggtttcacttttaggtgacttataaagtaatagggagaaatgagggcagatcattttgctagctctaactgaagaattccagtcaatcaatactgtggctgttatcggctttataaaagactactattcccagcatgcctcaaggcacctccaggaagaccttgactcccagcattctgtactttggaactccgagtcccagaatgcaacattcctcctacttcctctcagggggccgtcgagactacagttcccagcatgcagcgccgccacctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaaaaaaagtg

SEQ ID NO: 428354 - DNA, 3146 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccaggcagtcgacaagtactttaagcttcctcatgcttccagtaaaccaccccggatttcaggaagccttgtggacacttcatataaaacattaagatttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaaaaaaagtg

SEQ ID NO: 428355 - DNA, 2782 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaacaaactgaagacttggggtgagcaaagtattccagaaatgaatccctggtgctttgtgattcatgctggaaaaacaccaacagatcacaacaccttgagaaacagaaccagagagaaaaccacaaatgccaagcctgtttatatttagttttattcatgtttactgctttcctcttgtgaaatgatctagctaggcaggatgagggatactagcttagtaactaaactgtatttatatttatcacaattataaatgaactttagaagacacgagagattgctctgctgtttttgtatgcaatcaatgaatagtttaagacttccaatttaaattaaagttaaataaagttaaaaattcaatttgtcagtcaccctagccacatttgaagtacttaataactacatgtgtttagtagctactgtattggacaacagaagtataacatctttccctacttccagaaagttttatcagatagtgctattctagacaatacacttagaacttaatgttttttcatttactcttttcaaagaccctgtgaa

SEQ ID NO: 428356 - DNA, 1487 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaaca

SEQ ID NO: 428357 - DNA, 308 bp, Homo sapiens
aaactgtagccccgatttaggtctgttcttcccttaaagctccctcatgtacctcataagaaagtattagggaaagagctttataaagatatcgaaggagaggagtctgtcaacattgttatttagacataatatttgtgtctcaatgtggagacttaagtgtgttaatatttagattgcatttttcctagaggattaatagtaatttctgcattcacaggcaggttcataggccacttgacacagtgagtggcctcttaaatctctcgttactctaccatgtctggctgtgtggtgtctttctcctg

SEQ ID NO: 428358 - DNA, 5180 bp, Homo sapiens
  misc_feature (44)..(44): n is a, c, g, or t
agtaacatgatacgatcgagctcggacccagtgcgcaacgcgtnctattgtggagaagaccaccacatcctttggtttcacttttaggtgacttataaagtaatagggagaaatgagggcagatcattttgctagctctaactgaagaattccagtcaatcaatactgtggctgttatcggctttataaaagactactattcccagcatgcctcaaggcacctccaggaagaccttgactcccagcattctgtactttggaactccgagtcccagaatgcaacattcctcctacttcctctcagggggccgtcgagactacagttcccagcatgcagcgccgccacctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaaaaaaagtg

SEQ ID NO: 428359 - DNA, 4725 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcaggctataccacccatctgtctcagcctcccaaagtgctgggattacaggtgtgagccaccgcgccaggcctcagaccacttcttttgggtggcaatggtttggatatcgtttgtcctcactaaaatatcatgttgagattcgagccccagtgtggcaggtgttgggatgtggggcctcataggagctgtgtggtc

SEQ ID NO: 428360 - DNA, 2552 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttaca

SEQ ID NO: 428361 - DNA, 1346 bp, Homo sapiens
tccaggctagtcgagcctgtgttatcggccgaggcagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttaca

SEQ ID NO: 428362 - DNA, 3040 bp, Homo sapiens
cggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccctccgaacgcaggccccggcgcagagggcgggggcagctggaaggggcggcctttcccgtgcggcgcctgtggccgcagcttcaagtgctcctcggacgcggcaaagcaccggagcatccactcgggggagaaaccgtacgagtgcagcgactgcgggaaggccttcatccacagctcgcacgtggtccggcaccagcgggcgcacagcggggagaggccctacgcgtgcgccgagtgcggcaaggccttcggccagagcttcaacctcctccggcaccagcgcgtgcacacgggcgagaagccctacgcgtgcgccgactgcggcaaggccttcggccagaggtcggacgccgccaagcaccgccgcacccacaccggggagaggctgtacgcgtgcggcgagtgcgggaagcgcttcctgcacagctcgaacgtggtccggcaccggcggacccaccacggggagaacccgtacgagtgccgggagtgcggccaggccttcagccagagctccaacctcctccagcaccagcgcgtgcacacgggggagcggcccttcgcctgccaggactgcggccgcgccttcagccgcagctccttcctccgcgagcactgccgcatccacaccggggagaagccccaccagtgcggccactgcgggcgcgcgttccgggcgctgtcgggcttcttccggcaccagcgactccacacgggcgagaagccgttccgctgcaccgagtgcggccgcgccttccgcctgagcttccacctcatccagcaccggcgggtgcatggcgccgagtgagccggggctgcggcggaagagatgccggcggcctggtgggcgcgaggccgaggccgggggaggctcctgtccgccccgtgcgcggtgaggaagtaacagccggctgcgcgcctggttctcgggttgcgaaagcctcgccaggcctgcatccgccttggcttgggagcaatcaggagagacagggctcggggaaggcgagcgctgcccgcgggaggcgattcccagaggcggggaggtctcaggggtctgtcccgggccggccgcccgcctctgagactccccgcctcccacggtcagctgctgcggggcagtggccggtgattgaatcggtcattcctccgcaaccaggcctccatcaaaaccctgcatgagatgagggcctcgggcttcgggttggtgaaggcggggtgggggggcagttaggaagggggcgcccagacagggcatggaagcctcgcgtcctcccccgtaccttgcgggtcggtggttcatccatgtatttcaacgccttttcacagccggttcatatggtcccgacttctgtgtgcttagaaaattatggaacttggccgggtgcggtggctcccgcctgtaatcctagcactttgggaggccgaggcgggcggatcacacggtcaagagatcaagaccatcctggccaacatggcaaaacccccatctcgactaaaaatacaaaaaattaattgggcgtggtggcgtgcgcctgtaatctcagctacttgggagcctggggcaggagaatcacttgaacctgggaggcggaggttgcagtgagcggagatctgggcactgtactttagcctgggcgacagagagacccatctcaaaaaaaaaaattggaacctgagaagggggtcgtggggtccccggggcccaccgtctgcacttggcatctgaagtcggggtggtcttgtgggactgaccccttaccctgtgggttctgcactagctccgggcaattggtgacagaatcgagttaaattgtaggacatcgcgttggtgtctgagagggagttggagagctggttggtgtggagggaaaggcttacacacatgtgatttcagaagcgttctgtgggtagaggaatcgttttctctttgagactgttatgagtatgtacaaatgttatttcctgtaaaatattttcattttttaaaatgttattttctagatagaaaagtagaagtgtctctttggggagcgtttttgggggcgtatagtaaagctctgtcatcatgaattaagcgaggtgggctttgagtttcttgggatgacagggaaatgtgagccgcctactggccgtgagcccctggggtgcggttgcaggattcgcccatcctggtctgggtgtggcttgtgaccacctcctgcagttctctgcccaggtaaggactaattgggaagaattctgggtcctgagctggctgccgcttccaagacagtcgctttgagggctcttggcaccgattttgttaaaatgcatgagcttagggttgtgc

SEQ ID NO: 428363 - DNA, 862 bp, Homo sapiens
ttacattaaatttttttatgtagttgaatttgtcagacatctgatgtcaggcttagaaaaatcattcctcattccaaaactttaccattcaaataagttgttcttttcttctggtttaacatttttatattcaaatccttataactaccaagaaaattttaaaacccatgggaatttctctagacatttgaagactgctggagggcgcgggcttcctcagcatggagctaggaagctgtggccacgcccacctgtgctctgcgtcagccctgggtggagggggacccgcagagcctggaccagagttcctgggcatcccacagaacagaacacccgcttctgggagtgtctgttgagccaggaccttgattgctagtgacaggagtgggcccagctgggtgatgcagctcccacagggcctgttctgacagtttcctctgaaggcattctgacctcactgcccctggcccctgtacctagccctggctgtgatttattttccttttcttttacctaagcagaaattgttccaactgctggtgttctgcaagatggagccaggaggagagcccacaggtgctaaagagagcagtaccctgatggagtcccttgcaggtgaggggacatgtccacagtcgggcccagagttccagggcaggaattgaacaggaatacaggaaaaacaccatgtctcagtcactgacgcagagcatatactgtgtccttgggcgcagggtgagggagggaggtaaacgcaggcccatcagatctcctgggcatctgtttggtgactgtctttgccagtgaactgagagcttttggttagaaagtctggcagccccaggctctgcctctgggaagg

SEQ ID NO: 428364 - DNA, 705 bp, Homo sapiens
cggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcaggtgaggggacatgtccacagtcgggcccagagttccagggcaggaattgaacaggaatacaggaaaaacaccatgtctcagtcactgacgcagagcatatactgtgtccttgggcgcagggtgagggagggaggtaaacgcaggcccatcagatctcctgggcatctgtttggtgactgtctttgccagtgaactgagagcttttggttagaaagtctggcagccccaggctctgcctctgggaagg

SEQ ID NO: 428365 - DNA, 3791 bp, Homo sapiens
ggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggacaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcggcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgtaaaaaaaaaaaaaaaaaaaaaagggcggccgctcgccgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttg

SEQ ID NO: 428366 - DNA, 2960 bp, Homo sapiens
ttccaccaccggcaccaccacccgcacgcgtcaatatacgtctaggtagccgagcgctgggttcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcggcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgtaaaaaaaaaaaaaaaaaaaaaagggcggccgctcgccgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttg

SEQ ID NO: 428367 - DNA, 3009 bp, Homo sapiens
ggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggacaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcggcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccaggtccctggtgctgaaccgcctgcgtccagttgccagcgggggtgggaaagcccaaccgggctccccttggtggcggagcaaaggctaccgctgcatcggaggggtcctctacaaagtatctgccaacaagctctccaagacctccggccagcccagtgatgcgggcagcaggcccctcctgcgcacaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccacggctcccaataaaaatgtgaaaacaaaaaaaaaaaaaaaaaaaaaaaaaaaaaaaaaaaaaaacctcgacggagggcaaaaacagaggaggcgcgcgcagaaaacaacgacggcaacacacacaacgcaggcgcgaggccacatcacggtggttcacgacgcacccacttctgtggacacagggggggaaaccaatgcggggccccccaaaaggagagcgacaaactacttcgcgacaaccacggtaccctcggcttaatgcactgcgacacaacagtacacagcacacgcgacccaataaccagacacatacacacagccacacgacagcaccaaag

SEQ ID NO: 428368 - DNA, 2191 bp, Homo sapiens
ggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggacaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcaggcccgggaggcctcgctggttgtgacctgtcgaactaacaagttccggaaaaacaactacaaatgggtggctgcctcctcgaagagtccccgggttgctcggagggccctcagtcccagagtggctgcagagaatgtgtgcaaggcctctgctggcatggcaaacaaggtggagaagccgcagctcatagctgacccagagcccaagcccaggaagccagccacgtcctccaagccagggtctgcccccagcaagtacaagtggaaggcctccagcccctctgcctcctcctcttcctccttccgttggcagtcggaggccagcagcaaggaccatgcctcccagctctccccagtcctgtctaggtccccgtcgggggacagaccagcagtaggacacagtggcttgaagcccctctctggggagaccccgctctcggcttacaaagtgaagagccgcaccaagatcatccggagacgcggcagcacaagccttcctggagacaagaaaagcggcacctcacctgccgccaccgccaagagccacctcagcctccggcggagacaggccctcagggggaagagcagccctgtcctgaagaagacccccaacaagggcctggtacaggtcaccacgcaccgactatgtcgcctgccaccgagccgggcccacctccccaccaaggaagcgtccagcctgcatgccgtgcggactgcacccaccagcaaggtgatcaagacccgctaccgcattgtcaagaagacgccggcctcgcctctcagcgccccgcccttccccctgtctctgccctcctggcgggcccggcggctctcactatccagataccactgtccttgcaagggccgcatgaagtttgctgaggtcaccacgcctttccagggagctgagccggatttgctgtgtggtcttcggaggggctgtcccagggcctgggagtggggggatgtctgctgtgagtctctttagacagcagtgacctgaggggtccttgagggcctaggcaggattcctggccagcctgcccctcagtagctggcacagacagagtgggtcctgggccgatgacccagcccaaagggtggcacaggtgcagagggtcgcgggcccgccaaggacagctgcacctggccgcctggcacctctgccggacgagctgaactcggcactccggggccatgaagtcccactaatacttgtttttttgcagctgacatacaaaacaccaatagcttcagctgaaatggatttttaaaagtgtcattttatggagaaaatta

SEQ ID NO: 428369 - DNA, 3197 bp, Homo sapiens
ttacattaaatttttttatgtagttgaatttgtcagacatctgatgtcaggcttagaaaaatcattcctcattccaaaactttaccattcaaataagttgttcttttcttctggtttaacatttttatattcaaatccttataactaccaagaaaattttaaaacccatgggaatttctctagacatttgaagactgctggagggcgcgggcttcctcagcatggagctaggaagctgtggccacgcccacctgtgctctgcgtcagccctgggtggagggggacccgcagagcctggaccagagttcctgggcatcccacagaacagaacacccgcttctgggagtgtctgttgagccaggaccttgattgctagtgacaggagtgggcccagctgggtgatgcagctcccacagggcctgttctgacagtttcctctgaaggcattctgacctcactgcccctggcccctgtacctagccctggctgtgatttattttccttttcttttacctaagcagaaattgttccaactgctggtgttctgcaagatggagccaggaggagagcccacaggtgctaaagagagcagtaccctgatggagtcccttgcagctgtgaaggctgctttcctggcgcaggccccgagtggcagccggtcagccgaggtgcaggcagctcagagcacggagcctgccgcagaggcaggcgctcccgagggagagggccacagaggggggcctccccgggcgttggggtctcttggcctttgtgaaaaccaggaagccagagagaggcccggaggttcccctcgaggcccggtcacttctgagaaaactggaggacagagtggcctcgagtcagacgtccctccgaacgcaggccccggcgcagagggcgggggcagctggaaggggcggcctttcccgtgcggcgcctgtggccgcagcttcaagtgctcctcggacgcggcaaagcaccggagcatccactcgggggagaaaccgtacgagtgcagcgactgcgggaaggccttcatccacagctcgcacgtggtccggcaccagcgggcgcacagcggggagaggccctacgcgtgcgccgagtgcggcaaggccttcggccagagcttcaacctcctccggcaccagcgcgtgcacacgggcgagaagccctacgcgtgcgccgactgcggcaaggccttcggccagaggtcggacgccgccaagcaccgccgcacccacaccggggagaggctgtacgcgtgcggcgagtgcgggaagcgcttcctgcacagctcgaacgtggtccggcaccggcggacccaccacggggagaacccgtacgagtgccgggagtgcggccaggccttcagccagagctccaacctcctccagcaccagcgcgtgcacacgggggagcggcccttcgcctgccaggactgcggccgcgccttcagccgcagctccttcctccgcgagcactgccgcatccacaccggggagaagccccaccagtgcggccactgcgggcgcgcgttccgggcgctgtcgggcttcttccggcaccagcgactccacacgggcgagaagccgttccgctgcaccgagtgcggccgcgccttccgcctgagcttccacctcatccagcaccggcgggtgcatggcgccgagtgagccggggctgcggcggaagagatgccggcggcctggtgggcgcgaggccgaggccgggggaggctcctgtccgccccgtgcgcggtgaggaagtaacagccggctgcgcgcctggttctcgggttgcgaaagcctcgccaggcctgcatccgccttggcttgggagcaatcaggagagacagggctcggggaaggcgagcgctgcccgcgggaggcgattcccagaggcggggaggtctcaggggtctgtcccgggccggccgcccgcctctgagactccccgcctcccacggtcagctgctgcggggcagtggccggtgattgaatcggtcattcctccgcaaccaggcctccatcaaaaccctgcatgagatgagggcctcgggcttcgggttggtgaaggcggggtgggggggcagttaggaagggggcgcccagacagggcatggaagcctcgcgtcctcccccgtaccttgcgggtcggtggttcatccatgtatttcaacgccttttcacagccggttcatatggtcccgacttctgtgtgcttagaaaattatggaacttggccgggtgcggtggctcccgcctgtaatcctagcactttgggaggccgaggcgggcggatcacacggtcaagagatcaagaccatcctggccaacatggcaaaacccccatctcgactaaaaatacaaaaaattaattgggcgtggtggcgtgcgcctgtaatctcagctacttgggagcctggggcaggagaatcacttgaacctgggaggcggaggttgcagtgagcggagatctgggcactgtactttagcctgggcgacagagagacccatctcaaaaaaaaaaattggaacctgagaagggggtcgtggggtccccggggcccaccgtctgcacttggcatctgaagtcggggtggtcttgtgggactgaccccttaccctgtgggttctgcactagctccgggcaattggtgacagaatcgagttaaattgtaggacatcgcgttggtgtctgagagggagttggagagctggttggtgtggagggaaaggcttacacacatgtgatttcagaagcgttctgtgggtagaggaatcgttttctctttgagactgttatgagtatgtacaaatgttatttcctgtaaaatattttcattttttaaaatgttattttctagatagaaaagtagaagtgtctctttggggagcgtttttgggggcgtatagtaaagctctgtcatcatgaattaagcgaggtgggctttgagtttcttgggatgacagggaaatgtgagccgcctactggccgtgagcccctggggtgcggttgcaggattcgcccatcctggtctgggtgtggcttgtgaccacctcctgcagttctctgcccaggtaaggactaattgggaagaattctgggtcctgagctggctgccgcttccaagacagtcgctttgagggctcttggcaccgattttgttaaaatgcatgagcttagggttgtgc

SEQ ID NO: 428370 - DNA, 1461 bp, Homo sapiens
ggccgtcgcggactcgggagatggaggaaaaggagatattacggcggcagatccgcctactgcagggtctgattgatgactacaaaaccctccacggcaatgccccggcccctggtaccccagcagcttctgggtggcagccacccacttaccacagtggcagagcctttagtgcccgctaccctcgtccaagccggaggggctactcttcccaccatgggccttcgtggcgcaagaaatactccctcgtgaatcggcccccgggaccctcagaccctcctgccgaccatgctgtgcggccgttgcacggggcccgggggggccagcctcctgtcccgcagcagcatgtccttgagagacaggtccagctcagtcagggtcagaacgtggtcatcaaagttaaaccgccatcaaagtctggctctgccagtgcctcaggggcccagcggggctctttggaagaatttgaggacaccccctggagtgaccaaaggccccgggaaggtgaaggtgagccccctcggggacagctgcagccctcgaggccaacaagagccagggggacctgcagtgtggaagatcctcttctggtctgccagaaggagcctggtaagcccaggatggtgaagtcagtgggcagtgtgggcgacagcccccgggagccccgccggacagtcagtgagagtgtgattgccgtcaaggcgagcttcccatcctccgctctgcccccacgcactggcgtggccctgggccggaagctgggttctcattccgtggccagctgtgctccacagctccttggggacaggagagtagatgctggccacacagatcagccagttccgtctggctcagtggggggccccgccagaccggcctcaggacccaggcagggcaggtgttttatgttcagcaataaaggttctatccgtaaaaaaaaaaaaaaaaaaaaaagggcggccgctcgccgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttg

SEQ ID NO: 428371 - DNA, 2326 bp, Homo sapiens
cggggcggggaccgtagcgggtgcagtccagctgctctggacgctgaggccccggcttctcttgctggggtgtcgattcgggagggctgagggcgcggccgagagaacggggcggtcaccgccgccgtggcccgcgcgtcccgcgctctccttgcagtgcaggccccagccgctctcgggcgcggcgtgggggaggcggccctgcaggtgcgtacccggggtccgacacgtgcggggcttcctgcgagctgagtccccgctgcgcgtcttcaggcctttgtaagttgtcaaatttcccaccggcccagctcatcgagcttcttcccagctgtgaacaggagggcctgttccctaattcttgccgaaattgttccaactgctggtgttctgcaagatggagccaggaggagagcccacaggtgctaaagagagcagtaccctgatggagtcccttgcaggccggctggatcctgcaggcagctgtagccgttccctggccagccgggcagtgcagcgcagcctggccatcatccggcaggcgcggcagcgcagggagaagaggaaggagtactgcatgtactacaaccgcttcggcaggtgcaaccgtggcgagcgctgcccctacatccacgatcccgagaaggtggccgtgtgcaccaggtttgtccggggcacctgcaagaaaacggatgggacctgccccttctcccaccatgtgtccaaggagaagatgccggtgtgctcctacttcctgaagggcatctgcagcaacagcaactgtccctatagccacgtgtacgtgtcccgcaaggccgaggtctgcagcgacttcctcaaaggctactgccccctgggtgcaaagtgcaagaagaaacacacgctgctgtgccccgactttgcccgcaggggggcgtgtccccgcggcgcccagtgccagctgctccaccgtacccagaaacgccacagtcggcgggcagccacgtcccccgccccagggcccagcgacgcaaccgccaggagcagggtctcggccagccacgggcccaggaagccttcagcatcccagcgccccaccaggcagacgcccagctcggctgccctcactgcggctgccgtggctgcacctccccactgcccaggggggtcagcctctccctcatcctcgaaggcttcctcctcctcctcctcctcctcatcccctcccgcttccttggaccacgaggcaccatctctccaggaggctgccttagcagcagcgtgctccaacaggctctgcaagctgccttccttcatctccctgcagtcctcgccgagcccaggagcccagcccagggtccgggcccctagggcccccctcaccaaggactcagggaagcctctgcacatcaaaccacgtctgtgaggaccccagggaccggcctgcacctacctcagaccctcatccttggagaggaaagaggctctgtccaccactctaccccacaggagggccgcccgccaccaagcctcacctgggggccacagggacactgctctgcctgcctggccctcaaccttccatgaccagcgtgtgcgcagggcctggtcttcctcccccaagccaggcccctgtccccaccccaccaccttccagggtgccaggcagggctggcctccaggcctgtccccgactgccattggcaacagtggccctgcagcccccagccctccccacccaggttttcggcccagtgaagaggccactggccaggcctcccaggcaggtgttttatgttcagcaataaaggttctatccgtaaaaaaaaaaaaaaaaaaaaaagggcggccgctcgccgagttttatacagttgtatcacatcgaaaagtgtctttactgttttctgtgtggccatcatgtttaagttgaggaaaactcagttcttaaattatctgggaagggtctggattctctatttttgagattgactttatcacaatatgattcttacatctttataccatttacaattgtgttttagatctacagagttagaaattcgaaaactattccaggactaattcttaatcggcattatttatacaagaggtcaagtaacatttactagcgcaatactgcacttgtaaatgaattataaacgctcttctggaatatatttaaataaccattaaagaactgcttattcattctggacactgcatgttgatgttgaatcaactgatgccagcagaaagctattttgatttgtgaacatactgccttatttaaagggtcctgattgcttgtattttaagacattcattaaaaagaaaccaggaaacacttttg

SEQ ID NO: 428372 - DNA, 2304 bp, Homo sapiens
atctggtagcaagagcagtctcttcgacactgaatctgccagcacctgatcttgggccagccttcagaactctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttgatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgttttttttttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttctgaggtagaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatataactagaataatttttttcctttcttttatggacctaaatctgcaattgggaatttgtgcatgaaatatgaagttactttttatagataatccagtgcttttaagtccctaaaaggtcctgtgaagtaatgatgatgttataattaaaagctttgaagggtgaaactacatatggtacctagtattgggctctaaggagggaaggggcagctcattgttgagagttgcatgctgca

SEQ ID NO: 428373 - DNA, 2259 bp, Homo sapiens
atctggtagcaagagcagtctcttcgacactgaatctgccagcacctgatcttgggccagccttcagaactctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttgatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgttttttttttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagcgtaagagcaagtataggatatggagaggcccctggcttcatgagaacaaaggcaggcccaggttataattacagctttctcctgccccttctttactttctctaccacagttttctccactgtttgttttcctcttgccacaatttgctaacatttaaaaaattttcctgcacccagtagtttcatatcctgtagacatcctcttaggacattctcaaatttcaaaataaaaaatattcatctatgtagttaattaaagttaaagtttttgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttctgaggtagaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatataactagaataatttttttcctttcttttatggacctaaatctgcaattgggaatttgtgcatgaaatatgaagttactttttatagataatccagtgcttttaagtccctaaaaggtcctgtgaagtaatgatgatgttataatttctaaggagggaaggggcagctcattgttgagagttgcatgctgca

SEQ ID NO: 428374 - DNA, 153 bp, Homo sapiens
ctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaa

SEQ ID NO: 428375 - DNA, 783 bp, Homo sapiens
aaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgcttt

SEQ ID NO: 428376 - DNA, 1984 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacaataacaatatcaactgaatataaaatattaatgccatggatgatctcagaaatgatttcctacaaagtcccaacctatcctggaacatttcttatgtgtgcttgggagattgcaagaggacaactcggctctaaaatcgatgcattaacatgtcattggaattgaccttgccaaaagatgcctccctaaatccacaagaatctccttgtttgaacacagtttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagagtctcatcaggatatcatgttgcattgagtagtcatgtctccacaggcttttcttggctgcgactcttactcacgttttccttggttttgcccaccttacagtttacagtagtggtcaggtattttgtagtatgtccctcacttgggctttgcttgatgcttatctcctgagaaaactagggatatgtattttggggaggaaggccacagagatgaagtgacattcttttcacatcatatcaatgctacatactatcaaaagggcttatcactgttgatgttaattttaatcacctggctaagatattctttttcaggattttgactttaaagttaccctttatgcttttccttctcataaagtgctctttgaaatgaagtcactctgtgcagcagacatttaaaaagcaggaaattatggtgacagagtatctgtataaattatttgcagttcttttattttcagagtttggaattatagcactcctataaatcttattactaatggtgccacaaattgtgtactactgatatgtattagtgcacaacttaaagcatgtggacatgagctgtatttgaaaaaacattcagatggaagagctacctgatttgaagtgaatcttaattggaacttaatgatgcctcctagtaatttactattttagctgaacctacagtatcagctgtagcccagaaaatataagagctacaattcgtacaattcaacatcagctgccaaggcccacctggactgcacctgcaaaaccagctgtggtttctttgctctcacaattcatgtcagtgtttttcagccaatgcatcactggtttcgaattttatactgtccctctctcagtcctccacccctctagtttctaaatgatagagaataattaggtgaggtttaaactctcaggattattcagggtttgtggagagtaggaaggtttcttccaggttacagcacaatttaaggagcctggcaagaagcatccaatattagcaagtagaaaagcagcataagtatgaggttggaacttcccacgatacttagtacatggaaaaaaatgtagaacataccaaaaaaaaagcaaattgtaaaaaaatttcacaaataaaaatactgttatgaaaattaaattataaaaaaaaaata

SEQ ID NO: 428377 - DNA, 1095 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacacccataggtcaaataaaagattaataatttagacatatcagctgtaaattcataagaaccatatggatgtccaagtggaggtggaggaggtgattaagatggaaaaaggcaaccatgaatgaagacacacagatcctcaacctttaaaacaggtgtggttaagagaaaaaaaaattgccattaaggaatcagcaaataggatgtctgaagtgaggatatagcacctatctctgagattaaagtcatctgatcaaaaatgatgcctctgagactataacaaaggaatgaataatgaaatataagaatggggattctgcactaactctatggggaagaaaacaatgcagagacgaagcttcaccgtgttagccaggatggtctcgatctcctgacctcatgatctgcctgcctcggcctcccaaagtgctgggattacaggtgtgagccactgagcctggccccagttttaattgttaatacagtaatatcaatagatacaacctgcataaactaaagctctttggggccttccatgacattaagaacgtaagcggtctcaagatagagaagtttcaggactaccactgtacatttttgtaacatttattttatttcttgtattgctaatttatctttatatagttgctattttataagatgtaaactccttg

SEQ ID NO: 428378 - DNA, 840 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacaggtgtggttaagagaaaaaaaaattgccattaaggaatcagcaaataggatgtctgaagtgaggatatagcacctatctctgagattaaagtcatctgatcaaaaatgatgcctctgagactataacaaaggaatgaataatgaaatataagaatggggattctgcactaactctatggggaagaaaacaatgtctctgttcatcatgagaaatgctcagcgactgcagacataaagagaaagctttcaattaaagtttcaatgatgggataggaactgagaagtctgtggagttttctgcctaggagtacccttggaaaagccactgctatgcccaaccagcactgggaatcccagatcacatgcaatcataggagttgccctggaggcagaagctcagcacatgttctggtaca

SEQ ID NO: 428379 - DNA, 1353 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacaataacaatatcaactgaatataaaatattaatgccatggatgatctcagaaatgatttcctacaaagtcccaacctatcctggaacatttcttatgtgtgcttgggagattgcaagaggacaactcggctctaaaatcgatgcattaacatgtcattggaattgaccttgccaaaagatgcctccctaaatccacaagaatctccttgtttgaacacagtttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagagtctcatcaggatatcatgttgcattgagtagtcatgtctccacaggcttttcttggctgcgactcttactcacgttttccttggttttgcccaccttacagtttacagtagtggtcagccgttctggacatacacatgggcagaagatgtagccgccttgtgtgaaaatttgagagctctctactccatcttccgctagtataaccctcattggctggaatcataatggtatctgcatctggaactggccactagtataacacctacaaaatgcacaacggccttcagaccatatgaaaagtctacagggtgagaatctgaaaatccagcaatgaggagaaaaaagttatctcccattaagaacactttccagaagctacacaattccagttattgattcatcccatttactagaacctgttcatctggctatgcccaaaaccaagggaaactgaaatagtggttaccatattctgtaactcagcctagcctagcttcagaagttttaataaagaaaataaaat

SEQ ID NO: 428380 - DNA, 1233 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacaataacaatatcaactgaatataaaatattaatgccatggatgatctcagaaatgatttcctacaaagtcccaacctatcctggaacatttcttatgtgtgcttgggagattgcaagaggacaactcggctctaaaatcgatgcattaacatgtcattggaattgaccttgccaaaagatgcctccctaaatccacaagaatctccttgtttgaacacagtttctaatccagctgtaatgaagacagacaacagtcaaattaacaactgatcaggaggagaagttcatactccttgagctggatctatctgcacatgcacctggcccaggaagctgaaatgggagatctgatgagcagtggaggactgaaccaaagcccttggcttttgctccataccagtcagccgttctggacatacacatgggcagaagatgtagccgccttgtgtgaaaatttgagagctctctactccatcttccgctagtataaccctcattggctggaatcataatggtatctgcatctggaactggccactagtataacacctacaaaatgcacaacggccttcagaccatatgaaaagtctacagggtgagaatctgaaaatccagcaatgaggagaaaaaagttatctcccattaagaacactttccagaagctacacaattccagttattgattcatcccatttactagaacctgttcatctggctatgcccaaaaccaagggaaactgaaatagtggttaccatattctgtaactcagcctagcctagcttcagaagttttaataaagaaaataaaat

SEQ ID NO: 428381 - DNA, 446 bp, Homo sapiens
ggaaagcccatctatggatacttatgtttatgagaatagagacttgactgtttaaatgtcagaggaatagagagtttggcaagcagaacaatcctatcagtgacggcctttggaaaaaatgggctatttttagtaaaagttttcataatgacatgatttaaagtaaaataaattagacttttgatttcaactctgtgttagagttctccagataaatggaaccaataaaaaatatttacaggaaatggctcacatattatggtggctaagaagtcctacgatctgctgtcttcaaactggagaaccataaatgtcaatggtgtaattcagtctgaatctgaaggcctaagaaccaagagaaatgatggtataattcctggtctgaatccaaaagcaggagaagatgtcccagttcaagcagaaggaataaattcattctttatctt

SEQ ID NO: 428382 - DNA, 466 bp, Homo sapiens
cttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccagg

SEQ ID NO: 428383 - DNA, 6762 bp, Homo sapiens
agtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaaggaaaaaaccatgttgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcccacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggccctagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgaccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcagtgtgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactact

SEQ ID NO: 428384 - DNA, 6832 bp, Homo sapiens
cttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaaggaaaaaaccatgttgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcccacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggccctagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgaccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcagtgtgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactact

SEQ ID NO: 428385 - DNA, 5440 bp, Homo sapiens
  misc_feature (3)..(3): n is a, c, g, or t
  misc_feature (27)..(28): n is a, c, g, or t
  misc_feature (73)..(73): n is a, c, g, or t
  misc_feature (87)..(87): n is a, c, g, or t
ccnaaacccccaaaaggttcccagganntaagggattcctggccttccacttcttcttccaaaaattcactcngggcttttcttccnttcccacccctcattcagctgctcgtggtggcaggaggtatgtctgacaggacagaagcaagctccccatcatcttgtcctagagtgggcgtcaccttggagcttctcttccttccgcctctgttcctcttctggagcctttgcctcccatctcttatctccttgatataattttgaacttgacctactttaaacttttttgctctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaaggaaaaaaccatgttgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcccacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggccctagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgaccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcagtgtgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactact

SEQ ID NO: 428386 - DNA, 5862 bp, Homo sapiens
agtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgatcatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaaggaaaaaaccatgttgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcccacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggccctagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgaccacgttggccaacatcgggggtactctggaacaactatcacg

SEQ ID NO: 428387 - DNA, 824 bp, Homo sapiens
  misc_feature (821)..(821): n is a, c, g, or t
agtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggactcatcatcaataaacactgttacagcaaaaanaaa

SEQ ID NO: 428388 - DNA, 996 bp, Homo sapiens
agtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcttttagagcttaagactgctgcagagtccggaggaagaggtcacctataagaatctgggacagggcagtaagct

SEQ ID NO: 428389 - DNA, 902 bp, Homo sapiens
agtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagatctgatgtgacaggaaaagggggaaaagattgaggccttgatgttagcatcaggtaaatgaggacaagagtgccctgagaatgaaaactttataggataaaatatcttcaaatgaaccaccata

SEQ ID NO: 428390 - DNA, 883 bp, Homo sapiens
cttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcttttagagcttaagactgctgcagagtccggaggaagaggtcacctataagaatctgggacagggcagtaagct

SEQ ID NO: 428391 - DNA, 471 bp, Homo sapiens
tcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaat

SEQ ID NO: 428392 - DNA, 2819 bp, Homo sapiens
ggatgaggggtgaaatttaaaagctcctgaaaatgagtactgctgtgttgagcttttctttcctggggtatattaatttagttatatttagcagaagaggaatataaccaaatgtgactaaaatatagcagaaattcaggttgtttgtaaaaattttaataacaaatagcatttggcaagtctataggattcttcctatctggaaattctattttgttagagtgcgataggacatatggaaaaccaacacaaagtgctttagcattaaaactcaccatcaaatagatgtaatcttattaattacacattttgtattttaattatttcaaggagtgaagaaaacagggtgtttttgtttttgtagttctgattactcatttatgcattgttttgtttaagtaaattctgcctacaagtgaaaaggtcggtgcgctcttctgtgcaccatcctcacggtgctatttccgaatatctgaatattgatttctaacacctggatgaggctgtgaccgatcaacttggaacactgtaaaggttttcgaatgggatacgctgtaggcacgttttaagaagtattctgttcctaaagtccaggtatgattggattaatatttataaaattattattaggaattatttaagtggggccaggcatcttgcaacattttctgattttttttttctttctttctaatctcattttggtgatatttaaacaaacataaatgattgtaactttgcagcttttttatttaggtagctttaatttatttatgaaagttaatccatttctgatacgtggtttttaaaaatatgaaatggatttatatatactatattcctcaaatccactgtatgtggacttatattcattttctccttttttcggaattgaaacattttaatttcaaattcaaatagaacatttaaaatgatttcattattattacccatactgttgccactcatattgtaagtcagttttttcattgctggtacaatgactcagtatttctttataaaaatctgttgttctgaaaatcaacaaccttagaaggattttgtcttagaaaatttccttggctttagttttatatcatatttagaaaataataatgaaaagcatccccaaaatttcaatgatgtgaatttttaaattacctttatttctttaaactaattccattgattgttacttaaattttccacctggaatcatggatttaaaatttccccacctcatggggaaaaaactaacccagaagttcaaagcctttaaagtttcatctgattctggccttagaattgtccttaaaagctttctcctggccgataggaggaagcatatatcaaggaggttctttcccttcccattatcattttgtggcaagccttaagttaacaatgtgtctaccaagaacaattgagttttctaaaagtaataatgaagattatgcaattctaactgtagaagagatagctattaaaataatcagtagcctgggcatagtggctcacacctgtaatcccaatactttagaaggccaaggctggaggactgcttgagtccagaagtttaagaccagcctgggcaacacggggagaccctgtctctacaagaaattaaaaattagccaggcatagttggcacgtgcctgtagcaccagctacttgggaggttaaggtgggaggatcacttgagcctgggagatagaggcttgcagtgagccgtgatggcaccattgcactccaaccggggtgacagatgaggtcctctgtttacctccccccccaaaaaaaaaattcagtaggaattccttcatagaataacatgttatttattggtattgacttcttattagacagagctcatagtatttgttttctgctccgaacacttaaaaaatactaagacgtgatagtgaaaatagctttgaaaagaaactacatatggcaaaggtggggaggggggaagatgatgcattctgatcattataaagaatacttttcagggctctatcattttctccctttctctaatcatccagaatatggcgggtgtcccagtgttcaacagtatcatgctaatattccatttgatcggtagtccaagttctttggccagatagtgcaatgttgtgacaccgaccgaagcctttgttctggatctttcttcctattgaaggtggctgctggtggcttcataattttctgttttttttctcacaaagtaaatggtgggcatccatgtttacattgcaccttcccgtgctgtaattggcttgacaaagacaagcaggcttctctgttgagacttattgtgtttttagttttcatagacacttatttaatctttttaaattgtacagcaaggtgctctaagtaatattcgataaaatatatttaatagaaatttgcgtttgatattcatgaacatgaatacatgtatttttttaagaaataagtattgtgtaacactatggcattgcttctatagccaaagtataaaaatttctggaatactgacatgtaaagactacagttaattctgacactgtatcttattaaaataggatgatttgcattttgtaaaattatcctgcacatcaagctgcatgccttaaagcggaaactctaggactgtgttcatgggagagcagttcatctgttcagaacagtgaggcaaggtctgtagtgcttctttaactacctttggaaatactgtacaatgttagaataatttattttgctttacaggagtttgtcatgtattgactttaatattgtattttggtaataaattttttgttaaaaaaaac

SEQ ID NO: 428393 - DNA, 702 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaaggtaatagagaaaaccttgcacatagctactctgccttgagtctccccagtcttcagtagaaccccaccttggtcatagctggtacatcccttttccaatttataactcagcagtcatggggatgttggcacctcagagactgaccagttggcaatttagaacattctgtttcatat

SEQ ID NO: 428394 - DNA, 381 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccagcctgggccacagagcaagactccatctcaaaaaaaaaaaaaaagaaatgattggtcttgggggccggggcggtggcttacgactgtaatcccagcactttgggaggccaaggcaggcagatcatgaggtgaggaattcgagaccagcctggccaacatggtgaaaccccatctctact

SEQ ID NO: 428395 - DNA, 1977 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcaaaaaaaaaaaaaaagaaaaaaaaaagaaaaaaaggaaaaaaaaaaaaaaaaaaaaaaaaaaagaaaaaaaagaagggggggggggcataaaagaagaaccacgaaggggagcacaaaaaataggcaagaccaagcagatcagtgaaaaaaaagagggccaaataaaagaggcgcgcaaaaataagaaaaagaagcagaggcagtaaaaacaacgaaggaagagaaaaaaagaagaaagaaggaaaacgtggagagggaaaccacaacacagggaggggaaaaaaaacgggcagacaaaaact

SEQ ID NO: 428396 - DNA, 1710 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggacattaaaaaacaaa

SEQ ID NO: 428397 - DNA, 1764 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtgtgtggaagtcacagcttcatcaaggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggacattaaaaaacaaa

SEQ ID NO: 428398 - DNA, 1737 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctggaacaatggtgtatgggttgtttatgttacaaaagaaaagcgtacacaagaagaacacaatttatgaaatacaggataatacaggatccatggatgtagtggggagtggaaaatggcacaatatcaagtgtgagaaaggagataaacttcgactcttctgccttcaactgagaacagttgaccgcaagctgaaactggtcatcaaggccaagaaaaacaaggaaggaccaatgaatgttaattgaaatatgaaagctgaaatgcaacaaacaacttccgcttaaaacaattaagttgttaataactgtgattttgtaaatttcagtaattcatttaaatgatgtttcagtagatatattctagcatattaagagcttttataactgagttatagattagtttgctttctggaataaaattttcttcttatactcttccttttttttagatattacattttgcttttatgacattcacgaggcaaaaaataaaatatctttttttgaaggacattaaaaaacaaa

SEQ ID NO: 428399 - DNA, 1266 bp, Homo sapiens
attacataacttctttctagttaggaattaggacagtgtaagaaggccatctacaatcaagattgagagtggctctaacaagtgccatttttccttgttagctttcatttctcagccctttacaagattaaaatagtctgcagtttaatctctccaaagctttacggacagtgattctgtcctaaacaagacagtgactccaggatttctgaagactattgtggaagaagcatccattaaggccaagctataacatcagaaatggtgaatgaatacaagaaaattcttttgctgaaaggatttgagctcatggatgattatcattttacatcaattaagtccttactggcctatgatttaggactaactacaaaaatgcaagaggaatacaacagaattaagattacagatttgatggaaaaaaagttccaaggcgttgcctgtctagacaaactaatagaacttgccaaagatatgccatcacttaaaaaccttgttaacaatcttcgaaaagagaagtcaaaagttgctaagaaaattaaaacacaagaaaaagctccagtgaaaaaaataaaccaggaagaagtgggtcttgcggcacctgcacccaccgcaagaaacaaactgacatcggaagcaagagggaggattcctgtagctcagaaaagaaaaactccaaacaaagaaaagactgaagccaaaaggaataaggtgtcccaagagcagagtaagcccccaggtccctcaggagccagcacatctgcagctgtggatcatcccccactaccccagacctcatcatcaactccatccaacacttcgtttactccgaatcaggaaacccaggcccaacggcaggtggatgcaagaagaaatgttccccaaaacgacccagtgacagtggtggtactgaaagcaacagcgccatttaaatacgagtccccagaaaatgggaaaagcacaatgtttcatgctacagtggccagtaagactcaatatttccatgtgaaagtcttcgacatcaacttgaaagagaaatttgtaaggaagaaggtcattaccatatctgattactctgaatgtaaaggagtaatggaaataaaggaagcatcatctgtgtctgactttaatcaaaattttgaggtcccaaacagaattatcgaaatagcaaataaaactcccaagatcagtcaactttacaagcaagcatctgggtcagatgttgccatctgggtcagatgttgccatctgggtcagatgttgcca

SEQ ID NO: 428400 - DNA, 779 bp, Homo sapiens
gtaataaattgtgacttgtagctttaacaaaaattaggttccctagttgcagctgccagggaaagctagtctaatatcaaagcaaaccatccttcttctcaagcacagagtttttaagataggagtgtgtgtgtattgacattttcctagcagtggctgaagtcaaggaccaggagatttagggcccacttggagttcttatggtgaaacagtagtagcttcctagagacctttaaagcttatctgtaatttgtatagttcagaagatactgtatacatcattatttctccctgctttcaaaacagggaagggggtgtgggagagtaacacactaaaaaaagggataagtaattaatttctggggatttacaggcgtgagccaccgcgcccggccgcatcctaggtaattcttatgcatgatacaggttgagaccagtgccatgtacagaagtgggaaaaatggcttatgaaactcagttgtatttagcacactgtgttagacataaaatttgaaaacccaacctggacaacacagtgagacccagtctctactaaaataaaataaataagtgaacattgaaaaccaatggatagtagaatgtattcagttcagtgagacatgaaacaatatttttgcttaattgaatcaaacatatgttaaaaaaaaaaaaaaaactcaccctactcccaaagcactcaataaattcttcagagaaaaggaagagctttttgtactacattgcctctaaaatcttctgtaggataagacattttaaga

SEQ ID NO: 428401 - DNA, 434 bp, Homo sapiens
ataggagtgtgtgtgtattgacattttcctagcagtggctgaagtcaaggaccaggagatttagggcccacttggagttcttatggtgaaacagtagtagcttcctagagacctttaaagcttatctgtaatttgtatagttcagaagatactgtatacatcattatttctccctgctttcaaaacagggaagggggtgtgggagagtaacacactaaaaaaagggataagtaattaatttctgggtaagaatttccttttggcttaaaatggactgatggtgtaagttcctccctttgcaagcagaagctttgaagatagtgagctagatgaagctctggacatcttgaatgaagtattctgtataagaaccaagtgtataataactgttagtaatagaggctgctcatagaaatgtcattgcattataattg

SEQ ID NO: 428402 - DNA, 401 bp, Homo sapiens
cgcggccgcgagtgccggcagctggcactgcccgcaccgggcaggcaccgggcgggaagagagagcgccctgcggctgccagctggctccaaggccgggtccagagccgggcgggacggccgcgacgggcgcattcgggtgggggctcatcaccgcccagccggcgtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtggtgagcagtatggcttgtgaccgggtggggtctcccaggtagtagggggcgccaggaag

SEQ ID NO: 428403 - DNA, 1309 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428404 - DNA, 1665 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaaaaaaaaaaaaaaaaaaaaaaaaaaaaggggggggggggaaaaaaaccccgggggggccatggccccttttgtgcaaggggggccccaacgagggacgctaaaaaagccagcggggccgggaaacccggcgggccggcaacatcgcgtcggctccgggaggacccctccttcgggggccataggggccccccgagaataagccgggaaaaaactcgcgttgcggggaccccgctctcgggggaatccgcgtaataataggacgccaccaaacacccccgcccccctggccaccgcacgaccatcccacgacaccacccagcgacacgcacgcaacacaaccaaagcggcttacggc

SEQ ID NO: 428405 - DNA, 1514 bp, Homo sapiens
  misc_feature (1359)..(1359): n is a, c, g, or t
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaaaaaaaaaaaaaaaaaaaaaaaaaaaagggggggggtaagggtcctggtngggggttgggcagaagaatgtgttttaagttgcctgtggcccaaaagccggggggaaggggggggttgggggaaaattttggtatgaatgtctgtgtgaaaaggcggtctgtgcagactattccatttggtccacaacaacaaaaacaaaaaagg

SEQ ID NO: 428406 - DNA, 1504 bp, Homo sapiens
  misc_feature (1349)..(1349): n is a, c, g, or t
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaaaaaaaaaaaaaaaaagaggctggtgtaagggtcctggtngggggttgggcagaagaatgtgttttaagttgcctgtggcccaaaagccggggggaaggggggggttgggggaaaattttggtatgaatgtctgtgtgaaaaggcggtctgtgcagactattccatttggtccacaacaacaaaaacaaaaaagg

SEQ ID NO: 428407 - DNA, 1183 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttttgcactaatttagtattcattcggatggtagataaagctgagtacttatgttgtctttatggtcatcatatgacttggtgtgaggggggggggagtggtaatttcagggggtgtggaattagcgaaacgagagggcaattgtaatttgaagatgtgtaagatttggttagaaaaggttaccgggttggagggtaaaattggggaaaaacggtttgggggaggggt

SEQ ID NO: 428408 - DNA, 1056 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgttttggggggtttttttttttttttttttttggggggggggggggggaggacagtgttttaatcgggggaaaaagggggagggaagggggcggccgcacccc

SEQ ID NO: 428409 - DNA, 975 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtcgaagacctctttgatggcatcaggacaggacttcacggtcgacg

SEQ ID NO: 428410 - DNA, 1258 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagatttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428411 - DNA, 903 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428412 - DNA, 661 bp, Homo sapiens
aaacagaggaggaagaggaggaggaaggaggggaggagaggagggggaataggagaagaaaaggagagaaggctcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428413 - DNA, 645 bp, Homo sapiens
atggcatcaggacaggacttcacggtgaaggtttcgagtacgtccttcttggggcagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428414 - DNA, 1236 bp, Homo sapiens
gaaagtcgttcactagaggctaccggcgtgggaattgttccatttcctgaagtgcatctgaacatgggcagccagaaggaggtctctcgctaatcagcccctagaaaccaacaagggccaaccaggttccttggggtcatgtcctctcttcccatgagggacagccccagacggaacatggtcctcgctgggatggccttggctcactgagtcttcccccacccccgcctgcctctgcccagccaagatataacaatacgttttaaaatagaatattaacactttgggaggccgaggcaggcggatcgcaccacagcactctagcctaagcaacagagcaagactccatctcaaaagaaaaaaaaaagagtattaaataacatacacacaaagacaaatgcaaaagtactaacctgtatggactaggactataggaaaacctggaatttgagcattaaatttggctctgagcttactttcccaccctgaaagttctccaaggaaaatgcttgtgcagctgactgccaacccccccagattcctcacgtcccgcacccttctcattatctggcctgcatctctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctagatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428415 - DNA, 658 bp, Homo sapiens
cccagcccaccctctgcccaccagttctcccgggtgagacgggggccatgggagggaggaggtgccctgggaggaaggattgtgtgtgacccaggtcttggtttgtctccccaagtctcctgtcctgatgccatcaaagaggtcttcgacaataaattccacatcatcggcgcagtgggcatcggcattgccgtggtcatggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428416 - DNA, 847 bp, Homo sapiens
ccctagttcatgaccttactacccgtcagtatgaccttgggcaagtcacttttcttttctgggtttaagtttcttttttttgtgtgtagttaagggtttgaaatagatgattaaagatttctgtttgttttaaaattgcctgatgtcagaaagggtttcagtcttgctcactgctgtatccccagtacagtagagcttggtacatctgacattactggagtagatcttaccttttctagttagtaatcatagaaccttgtgcaagtttcttgacatatttcctcatctgtaaaatggagataatacctgcttctatagggtttatggtgagggtggaattaaatctatgtgaagtatttaacaatgccaagcacatagcagcactcaaagtttgttgtcaccgaattaatgtatgattatctgttttgcatttcactcattcagatcatcatagttatttctttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428417 - DNA, 610 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgatctttttccaggtatcttagtctgtttgtgctgctataacaaaatactatagatcaggtggcttagaaacaaca

SEQ ID NO: 428418 - DNA, 1561 bp, Homo sapiens
ctgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428419 - DNA, 1392 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaaaaaaaaaaaacacaaaaccacccaccacaaccaacaacccccaaacaaaaaccacacccccacccaccaaacacaacacccc

SEQ ID NO: 428420 - DNA, 1175 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtctccaaaagattccagcgatagacatgttcgtcccccgccgttgcaaggtactaaaggcaagcgtaaaggcgctcgtctttggtatgtaggtggtcatcaattttaactgcaggggcttcgggggaaccgagctggaattc

SEQ ID NO: 428421 - DNA, 1401 bp, Homo sapiens
cgcggccgcgagtgccggcagctggcactgcccgcaccgggcaggcaccgggcgggaagagagagcgccctgcggctgccagctggctccaaggccgggtccagagccgggcgggacggccgcgacgggcgcattcgggtgggggctcatcaccgcccagccggcgtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtgcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428422 - DNA, 1136 bp, Homo sapiens
gacttggtggcgctgtttgaccggcatggtgagggctaacttagcctgggcgaacgggtgctgggactcctgtcacagcgcccgcagcagtccaggaagcacaccagcatcatgagggcgccggatcggatcagaatatagactcctgtgtagaagctggaattattattattagtttcttgctcgaagatgctcttggtctgagagtcgaatcggagccatagtccaatggcaaggacagcaatcccggcaagccagaagatgaagttaaatccgaacagcagttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428423 - DNA, 1463 bp, Homo sapiens
  misc_feature (1308)..(1308): n is a, c, g, or t
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagatttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaaaaaaaaaaaaaaaaaaaaaaaaaaaagggggggggtaagggtcctggtngggggttgggcagaagaatgtgttttaagttgcctgtggcccaaaagccggggggaaggggggggttgggggaaaattttggtatgaatgtctgtgtgaaaaggcggtctgtgcagactattccatttggtccacaacaacaaaaacaaaaaagg

SEQ ID NO: 428424 - DNA, 730 bp, Homo sapiens
cggctcgaccttgtctctcggctctacctgtgctctcggctctaccgtgtctctcggctctaccttgtctctcggctctaccttgtctctcggctctaccttgtctctcggctctaccttggtctctcggctctaccttgtctcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctgga

SEQ ID NO: 428425 - DNA, 1230 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaaggtaaactcagaccaggatcctggtgtccctgcccccattgctctggacaaaccctgcaagcatgaaagtgacagcagccaagtgctgcttcagcaagacccgttctgcctgtgaaagggccccagggcacccatctctttctctcccactttgggccctctgtttactcaagggcaataaaacaaaggccggaccaggggaatgacaagtgttctggcaccgcccactgctgccagcccggaagctctcaagggcaggcgtgcttctgagtcttggactcccactctgactttgtcagtggctcctgtctgtaagccagagttaatgtccaactccagaatagtaaaaggtgaccttacaaccatgtcagaaatagacccccaagcagggcctgtccctcctccttccctgacgtcctgcccagattttagggatccactagcatagccatccctttgttcccctttccatccaccagccagaaccacaaatatcgccgaacactcctg

SEQ ID NO: 428426 - DNA, 422 bp, Homo sapiens
gcccaaaggccctgagagaaggcagtgctagcagctgccatctgcccagtgacgttgtccaagcacaggcatctggtggctgagagcttagagagaacaagatggaacgcataacatttgttcgtggaggaagatgtgaaaatgccgtctctgcccctctctcgtctgcccattgtaggtgattaaggaagtccaggagttttacaaggacacctacaacaagctgaaaaccaaggatgagccccagcgggaaacgctgaaagccatccactatgcggtatgtcgccttggcaaagacaccctcctgcgctttctccggattgtgtctgcacacagggtgctgactgcaccagaccagtgcaaacattctaatcgtcttcttacaatttgtttctctcatccccatccctgccttctcgctg

SEQ ID NO: 428427 - DNA, 1247 bp, Homo sapiens
gctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagatacaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttccagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcggatgtggcattgtggggaactctagagcgaccatcacggcatccagctgcactgccgcc

SEQ ID NO: 428428 - DNA, 1378 bp, Homo sapiens
agttgatcctagaggatcccccgtcattttacgcacttgtacttctgctttttattcttcctcaagtagttctttactgcaagatgtctttctttgctctttgatgcggatgtggattgtgcaatccacatccgccgccagcagaaggaggaacagaggcaccgccaagtcggggagatacaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttccagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcggatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggcaagtaaa

SEQ ID NO: 428429 - DNA, 1203 bp, Homo sapiens
gctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagatacaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttccagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgcccagctcaacgcgcacctcgcattct

SEQ ID NO: 428430 - DNA, 2021 bp, Homo sapiens
gctccaggaaagggaagaacagcagctgcaccgccaagagcgtgacagaaaattcctcgaggaggaaccgcagctgcgccgccaggagcgcgaacaacagctgcgtcacgaccgcgacagaaaattccgtgaagaggaacagctgctccaggaaggggaggaacagcagctgcgccgccaagagcgtgacagaaaattccgcgaagaggaacagcagctccgccgtcaggaacgagagagaaaattcctccaggaggaacagcagctgcgccgccaggaactggagagaaaattccgtgaggaggaacagctgcgccaagaaacggagcaagagcagctgcgccgccaagaacgctacagaaaaatcctagaggaagagcagctccgtccggaaagggaagaacagcagctgcgccgccaggagcgcgacagaaaattccgcgaggaggaacagctccgccaggagagggaggaacagcagctgcgcagccaagagtctgacagaaaattccgcgaggaggaacagctacgccaggagagggaagaacagcagctgcgcccccaacagcgtgacggaaagtatcgctgggaagaagagcagctccaacttgaggaacaagagcagaggctgcggcaggagcgagaccggcagtaccgggcggaggagcagtttgccacgcaggagaagagtcgtcgtgaggaacaagaactatggcaagaagaggagcagaaacgtcgccaggaacgggaaaggaaattacgggaagaacacatccgccgccagcagaaggaggaacagaggcaccgccaagtcggggagatacaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttccagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcggatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggcaagtaaa

SEQ ID NO: 428431 - DNA, 1301 bp, Homo sapiens
gcagtgaatcgtatttggtcatagtcgttcctagaggtatcccacaatccacatccgccgccagcagaaggaggaacagaggcaccgccaagtcggggagatacaatcccaagaagggaagggccatgggcggcttctggagcccggcactcatcagtttgccagtgtcccagtgcgctccagccctctctatgagtacatccaagagcagagatctcaataccgcccttaagtgatgttgccaatatcttgacacctgccaaagcttccagcacgggaaaatgagaaacactgggtaccaagtgataactcagatgtttctggttgtgggaaaactctctgatattagaatgtcttttcttccaaaatcttaaactacgctcattttacgcactttgtacttctgctttttattcttcctcaagtagttctttactgcaagatgtctttcttttgctctttgatgcggatgtggtgtgcatttaaaaaaaatataaatcatttaatttgtttaagaaattttgtttgaggaacatgttcatttattgctttcagaagtaacaagagtaataggatgatttgagattctaaacaatgggtcggtttgtttaatgactgacccatcttgtggaaagtgcagatacttttaatgttcaagttgctatttcttcttgaacctaaattgatcattgcctccaaacagcatttcatcttttgtggcatagttagcacaaattccaggtaactaaatttttataacccttgaatagtgcagggggagtgacctctgcataaaaacttcctgtaaaatcagcccattactggaagaaatatctgttaagaataggtttagctttgaagatttagaatttaaattagattttttttaaactcaactccacttaaacacataatctcatgaagaaataatgaggtgtttctcaacttcagagttcaaattttaaaactgtgtctgttgtagtctatagtgttcattctacttccccaagttttgatgagtttcagaatattatgaacctttgttaattttagcttgttagaaggaagctgctcagaatcccataaacatctgtcttactctagggccaataagagatcacatagagcatgttgggggtgtaaaagggaaaaatgtgtgaacataggggcaaatttctagaggccctttgacaagacccatttgcccacaatcatttgaggcctattgataataccttagatatattcttgttgaaataattggactgtgaaaaattaataataaatgtttggcaagtaaa

SEQ ID NO: 428432 - DNA, 319 bp, Homo sapiens
caaagaagattcggacggagggtgagatagtacagaaatattgccgcgttacagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgccctt

SEQ ID NO: 428433 - DNA, 1182 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgcaaacaccccaaaggcagaatctgctattttgagttttccattaacttccaaagaattctggttttcaaaacaggagccagagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttg

SEQ ID NO: 428434 - DNA, 1119 bp, Homo sapiens
  misc_feature (772)..(773): n is a, c, g, or t
  misc_feature (775)..(775): n is a, c, g, or t
  misc_feature (801)..(801): n is a, c, g, or t
  misc_feature (803)..(803): n is a, c, g, or t
  misc_feature (813)..(813): n is a, c, g, or t
  misc_feature (819)..(819): n is a, c, g, or t
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaaaaaaaaaaaaaaaaaaaaaaaaaaaaaaaaaaaaaaaaaaaaaaacggggggnntnttagggggggggggaaaagggggtananaaagggggcnaggggnaaagggtgcggagacccatttttttggtaaagaggggggtaaaattcgggcgcggaccccccaataagggggagccccataataattgggaaaagaacccgggttaaacccggttaagaaaacgacgtcaaagaggcgcgagcgaaaacacccggccagcagggcgactgtcgtgtgctcagcagaccgctgcgtcgaccaccacggcgggaacacaacagtgcgagacgacaacacccctcacaccaccgcgagagcccgccaagcgcccagcatcaccgcgcaaccgtaacagcagca

SEQ ID NO: 428435 - DNA, 1009 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaaaaaaaaaaaaaaaaaaaaaaaaaaaaaaaaaaaaaaaaaaaaaaaccccaacttttttttttggtgaaaaaaaaaatttttttttttgtctctctttttctttttattttttttataacacccatatttttttgatgtacaaaaagggtgtgggagaaactatatgtgtgccgagtggcttctccctctatatatgtggaggcattgtattatatatttttggaatgaaaaccgccgcggtgtataaacccggtgtaatctaaaccaagatattgagaaaaggggagaca

SEQ ID NO: 428436 - DNA, 1349 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaaaacaacaacaaacaacaaaaaaaaaaaaaaaaaaaaaaaaaaaaaaaaaaaaaaaaaaaaaaaaaaaaaaaacaaaaagagagaggggcgggcgcgcgcgcacaagaagaaacccccgcgcggagggggcccacaaaagtatgacgcgcgatccaccgcgcgttttgtgtgtgctgaacaggggaggcgccccatagaggaagcgaccatcttatcattaagaacgccgagcgccacggcgccgcccgtgccaatttcaaacaacgtcggcgggcgagcccgagaacacaaacgggcaccacggggagaaacaactcggtggaaggacaggaacaaccacctaacagcggagcgggggggagggaaccaacaatagcgggggcggcaaaacaactcctcgcccaccagaagagatatattcttagagacgcccgccccaagagcaggagaaaaaatataactaacacttctctgcaagagggcgcacctataacgcgggagctgcacacaacaccactgaccgcgccaataaactatctggcccgccccgcgagagaaaaactttggcgggctcaacgccgcgcaactgctacatcattcgacgaacaaatctattttttcaccgacgga

SEQ ID NO: 428437 - DNA, 1289 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttctgcactatctgcgaaatggaagaacgtaataacacagatgtcgcgcagacatccaagactgctgtccaacatgatgtgccagtaccggggaatgggcctctctatgggcagtatgatctgtggcgtggcataagagggtcctggagatctatacgtggatgccacatgggactcggctctcagaaatatgtctccacagcctaggtgagacaactctagatgccctaccggagtcactggacagagggtatcgggcctaaatcttaagccctgaaagaaggccctatgacccttgggaccgcgcgggcctattgcttaatgccagtccaccaggagacaggtattctggagcggcggtcgccgaatatgtaccccccttgacaggacgatggtgggctgaaaagtatcaaacgacaaatgtctaagagtgacagcacggacgacacaaatatattgtcgtgagcatgtgacacgtggggagaacgcaaatcagacaacaaaggcgtcaagcgaacacagcacgcaacaaaacaaatcctgcaccatcagagcatcgcaacattgagttcactacaac

SEQ ID NO: 428438 - DNA, 932 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttcgacaaacgcctcactcttcctctaccccactcttctcctgcagccctcaccacccctctctcttcacccacgcggcaccttttcccctctctcttctcacattttcacctctctggcccctttgcgcacctcccttttccttcggcctctctctcgcctcccctcttccgccctctcttctccttccctctctacggcggccgttctcttcaccggcccg

SEQ ID NO: 428439 - DNA, 864 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaatacagccgggttccttccacaaacactagttttaaacgcgcgcgttaatcgataccgcgttgagcgtctgcccgcctgaaacagactccagcaaatccttggggtgccgttggctccctcagtttttgccccgggcgttatttta

SEQ ID NO: 428440 - DNA, 764 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgccctttgataaaaaccaaaccaatgctatctggctaacttccttgtcggccgctttgg

SEQ ID NO: 428441 - DNA, 1384 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaaaaaaaaaaaaaaaaaaaaaaaaaaaaaaaaaaaaaaaaaaaaaaaaaacaaaaagagagaggggcgggcgcgcgcgcacaagaagaaacccccgcgcggagggggcccacaaaagtatgacgcgcgatccaccgcgcgttttgtgtgtgctgaacaggggaggcgccccatagaggaagcgaccatcttatcattaagaacgccgagcgccacggcgccgcccgtgccaatttcaaacaacgtcggcgggcgagcccgagaacacaaacgggcaccacggggagaaacaactcggtggaaggacaggaacaaccacctaacagcggagcgggggggagggaaccaacaatagcgggggcggcaaaacaactcctcgcccaccagaagagatatattcttagagacgcccgccccaagagcaggagaaaaaatataactaacacttctctgcaagagggcgcacctataacgcgggagctgcacacaacaccactgaccgcgccaataaactatctggcccgccccgcgagagaaaaactttggcgggctcaacgccgcgcaactgctacatcattcgacgaacaaatctattttttcaccgacgga

SEQ ID NO: 428442 - DNA, 964 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaaaaaaccaaacaactcctaaaaacccaaccttcccatcaaaattttcaaaaaaacaaaaccttgggggggggccccgttcccaatttccccctatagggagccgattcccattactgggccgcggtttacaacttcggaatggaaaaaccctggggttcccaaattaaaccctttggaaaaaacccc

SEQ ID NO: 428443 - DNA, 778 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaagtgcatgcgcgccaggccccagcccgcctcacctttattcatgctggcggtagagctcaaacaac

SEQ ID NO: 428444 - DNA, 929 bp, Homo sapiens
  misc_feature (795)..(795): n is a, c, g, or t
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaacacttgggacctataatgacactcattgcaattcattggccgtcgttttccaacgacttgactgggaagaccctgncgaacccgacttaatcgcgttgaacaacatacgactttagccgctgttgatatcgtgaataggcccatacccttcggccttccaaatacttggtcatcccgaatggcagttgtttggtagccgttgtatggtgc

SEQ ID NO: 428445 - DNA, 1241 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgcaaacaccccaaaggcagaatctgctattttgagttttccattaacttccaaagaattctggttttcaaaacaggagccagagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttg

SEQ ID NO: 428446 - DNA, 770 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgccctt

SEQ ID NO: 428447 - DNA, 974 bp, Homo sapiens
  misc_feature (765)..(765): n is a, c, g, or t
  misc_feature (776)..(776): n is a, c, g, or t
  misc_feature (787)..(788): n is a, c, g, or t
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttaaaaaaaaaaaaaaaaaaaaaaaaaaaaaaaaaaaaaaaaaaaaaaaaaaaaanttttgggaaanatttggccaannccaggtgcgcctttggggagtgggtttaaattgccttgacgggggtttaaaacgcctgaactggaaaaaaccttgccctcaccaaccttaataacccccgcggttaacccccttttagcacgctgcggtaaaaccctatttggcccacccgatggcccttccaaaaagggcgccaacaagaattgt

SEQ ID NO: 428448 - DNA, 711 bp, Homo sapiens
aggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggagaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgccctt

SEQ ID NO: 428449 - DNA, 1494 bp, Homo sapiens
cggggatggtcctggcatcactcagcaccctctctgaggcagcgtggattaatttatgatgggtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428450 - DNA, 1738 bp, Homo sapiens
ccacggtgcgcgaaaccatcggctaggtacgaggcccgggtggttttagggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428451 - DNA, 1889 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctaaaaaaaaaagggcggccgcg

SEQ ID NO: 428452 - DNA, 1997 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcggggagccaagtttacatctgatcctggaagcctgtccaagtggagcagtcactctccagctgggtcccttgtgctctgcggttggacttcgcactctcgtgtgttgtggtcctgcacggtctcttggaggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428453 - DNA, 1788 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428454 - DNA, 1529 bp, Homo sapiens
tgctgggattacagatgggagccactgcgcccggccgaatccctgctgttctgttctcagggcatccagcaccctttatgccattttgtggatatgaagtgataaccagtgtgttggatatacgtgttgttttttctagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428455 - DNA, 1485 bp, Homo sapiens
  misc_feature (1168)..(1168): n is a, c, g, or t
  misc_feature (1179)..(1179): n is a, c, g, or t
  misc_feature (1221)..(1221): n is a, c, g, or t
  misc_feature (1260)..(1260): n is a, c, g, or t
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgattctctgggaggatttggggaagccngtgagcgggtntgtaggactgcactattttgcattttttctgtaaatcaaaanttatttccaagtaagagttggaaagccatctgaaggcangattgaaaagatagatacccctgggaaaacgtcaatccggccctgagtttggcaaaacgtttagatagaattctgaacccgaagcgggtggatcacctgaggtcagaagtttcgagaccagcctggccaacatgatgaaacgctgtctttactaaaaatacaaaaaattagttgggcatggtggtatgcacctgtaatcccagctactctggagctgaggcagag

SEQ ID NO: 428456 - DNA, 1618 bp, Homo sapiens
ctccttcccttgccggagacacctggggcctggttttgtggggctcccaccgtgggtgacgtcctcctaccctaaactctttgactgaatcatttctaacgtggggttttgaagaggtaccttaaatatgtgcctccaaagtgtttttggggtgaatgtgacagaacagtcgttgtgtaaattctctttgggccgttgtatgagaactcaaggtgaatcccgttcgtagcagggacacggcctctaacagtcttctcaggattcccgtgtgagttacttgccctgcttctgtgttcagatctaaaatgaataatccgagatccaggggcagccgggggcagttccccctgtggtccctatctaagccctcagcagatatctctgggtccgcttgcctctccttagacatgggcttctgattctgcccagggtctcaaggtagtctgaggcaaggaccagcgcttccgtcgcacctgtgttcattcaggttcttgttataagggtcaccagctgatgctggagaagtcactaccatagcagaggctcttcttgggaatggacaggaggcgaaggccctggtccgttagtctggggatgttggaaagagtctcttgccttgcagcatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428457 - DNA, 1746 bp, Homo sapiens
ctccttcccttgccggagacacctggggcctggttttgtggggctcccaccgtgggtgacgtcctcctaccctaaactctttgactgaatcatttctaacgtggggttttgaagaggtaccttaaatatgtgcctccaaagtgtttttggggtgaatgtgacagaacagtcgttgtgtaaattctctttgggccgttgtatgagaactcaaggtgaatcccgttcgtagcagggacacggcctctaacagtcttctcaggattcccgtgtgagttacttgccctgcttctgtgttcagatctaaaatgaataatccgagatccaggggcagccgggggcagttccccctgtggtccctatctaagccctcagcagatatctctgggtccgcttgcctctccttagacatgggcttctgattctgcccagggtctcaaggtagtctgaggcaaggaccagcgcttccgtcgcacctgtgttcattcaggttcttgttataagggtcaccagctgatgctggagaagtcactaccatagcagaggctcttcttgggaatggacaggaggcgaaggccctggtccgttagtctggggatgttggaaagagtctcttgccttgcagcatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcggggagccaagtttacatctgatcctggaagcctgtccaagtggagcagtcactctccagctgggtcccttgtgctctgcggttggacttcgcactctcgtgtgttgtggtcctgcacggtctcttggaggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428458 - DNA, 970 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacgtgagtgtcagcccagagcggcggcgggtgcatggggtccccgtgtgggggattgctgtgggggggttcctgcggggcggggcagcaagaggagattctctgggaggatttggggaagccggtgagcgggtctgtaggactgcactattttgcattttttctgtaaatcaaaaattatttccaagtaagagttggaaagccatctgaaggcaggattgaaaagatagatacccctgggaaaacgtcaatccggccctgagtttggcaaaacgtttagatagaattctgaacccgaagcgggtggatcac

SEQ ID NO: 428459 - DNA, 401 bp, Homo sapiens
gacagcgtcctcagtgctgttgggagcaccctccgctagggtgcggggagcgggcccctctgcacgcaggtcactggttcctcggcctcctgccgcccccagcgagctaacggctgtgctgtcctctaggccgtcatttccctgatggagatggggttcgacgagaaagaggtgatagatgccctcagagtgaacaacaaccagcagaatgccgcggtgagtgttgggctgtggtgagtgagtgtgggctgtggtgagtgagtgtgggctgtggtaagtgtgggctgtggtgagtgagtgtgggctgtggtgagtgagtgtgggctgtggtgagtgtgggctgtggtgagtgagtgggggctgtgatgagtgagtgtgggctgagtgagtgtgggctgtgg

SEQ ID NO: 428460 - DNA, 1869 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428461 - DNA, 1738 bp, Homo sapiens
  misc_feature (25)..(25): n is a, c, g, or t
  misc_feature (30)..(31): n is a, c, g, or t
  misc_feature (44)..(44): n is a, c, g, or t
  misc_feature (46)..(46): n is a, c, g, or t
aggaggagggagcaaaaacataagnctagnncgaggctgggtgntncagggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428462 - DNA, 1724 bp, Homo sapiens
ggggaggaactaagctagtagagctggtgttgcagggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428463 - DNA, 1911 bp, Homo sapiens
  misc_feature (1892)..(1893): n is a, c, g, or t
  misc_feature (1904)..(1904): n is a, c, g, or t
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctaaaacaaaaaaaaaacaaaaaaannaaaaaaaacanaaaaaca

SEQ ID NO: 428464 - DNA, 1849 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaatggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428465 - DNA, 1734 bp, Homo sapiens
ggccgcgacggcgcgcccccggcggctgctgcggcggcgggagcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcaggtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428466 - DNA, 1583 bp, Homo sapiens
cagctcatcaaggagtttacacctctggctcctaaaggagacggagtctttcttgggcagagctccgctgattcagttgtcatcgtctttttgctgctcttacgttcacctcagactttctgattacgtttctgtgtagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggaggccagagatgagctgacggaaatcttcaagaagatccggaggaaaagggagtttcgggctgatgctcggggagccaagtttacatctgatcctggaagcctgtccaagtggagcagtcactctccagctgggtcccttgtgctctgcggttggacttcgcactctcgtgtgttgtggtcctgcacggtctcttggaggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428467 - DNA, 1074 bp, Homo sapiens
cacataagcgatgcgtttctacctgtcacaacctgtggctccctgaagacaagcctgggagctgcactgccccccggctctgctaactacagtcatccctgcacttcctcggctttaggatgctgaaaaccaagatctgttttagcagagctgtgaggaaagaacgtggacggacagcgtcctcagtgctgttgggagcaccctccgctagggtgcggggagcgggcccctctgcacgcaggtcactggttcctcggcctcctgccgcccccagcgagctaacggctgtgctgtcctctaggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttccta

SEQ ID NO: 428468 - DNA, 264 bp, Homo sapiens
tgcgagtggctgctgggggaccggaagccctctccggaggagctggacaagggcatcgaccccgacagtcctctctttcaggccatcctggataacccggtggtgcagctgggcctgaccaacccgaaaacattgctaggtatgtgcgccttctttatgctaagtctcgggtcggggaggctggctggttcccttgcaggacaaataggtgctgcggaggcgatacggaggatccagcgctgaggatcgccgtgcgctggcagc

SEQ ID NO: 428469 - DNA, 2277 bp, Homo sapiens
aaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacgtgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacaagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatgtgttaaaactcacacaacatgatatatattaaaggttgcaggatgtttgaagtcaaaaaaaa

SEQ ID NO: 428470 - DNA, 696 bp, Homo sapiens
aaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttca

SEQ ID NO: 428471 - DNA, 2385 bp, Homo sapiens
aaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggagtattatcctatgtgggagcacaggaaagagccctggaccatagaaagccaagtacgagtagcaagaaaaccaaaagggtgggaatggatcaaaggtgtgaaaacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacgtgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacaagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatgtgttaaaactcacacaacatgatatatattaaaggttgcaggatgtttgaagtcaaaaaaaa

SEQ ID NO: 428472 - DNA, 2316 bp, Homo sapiens
gggagagatatgtactcaaaaataccttagtgtggatttatcagaacacacacttcaattaaatctatacttaaattctcttttattcttattttgtgtgaagatggtaactcccttcataacctcttggtgaaatgtgtttattattttacggacagttgacattcagggacgtggccatcgaattctctcaagatgagtggaaatgcctgaactctacacagaggactttatacagggatgtgatgttggagaactacaggaacctggtctccctggatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacgtgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacaagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatgtgttaaaactcacacaacatgatatatattaaaggttgcaggatgtttgaagtcaaaaaaaa

SEQ ID NO: 428473 - DNA, 2248 bp, Homo sapiens
gcctgtcagatgttcctggggaagacggaggctgaggattgcccacattgccctggagacgttagagggccaccagagggccatcatggcacaatgactgtggaggttggcctaggagcagggaaccatctggaaggagttcgagaccagcctagccaacctggtgaaaccccttctctactacaaatacaaaaattagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacgtgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacaagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatgtgttaaaactcacacaacatgatatatattaaaggttgcaggatgtttgaagtcaaaaaaaa

SEQ ID NO: 428474 - DNA, 2478 bp, Homo sapiens
atctcctgcctgtgtcctcctcgctccctctgctccagccaagcatgcgtccttcctgttcctgggccgagcttgctcctgcctcaaggccttcacgtgggctgtgcctctgctggaactcgctggcccctcagctgcagcattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctgggctggagtgcaatggtgcaatctcggctcactgcaaccttcgcctcccggattcaaatgattctcctgcctcagcctcccgagtagctgggattacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacgtgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacaagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatgtgttaaaactcacacaacatgatatatattaaaggttgcaggatgtttgaagtcaaaaaaaa

SEQ ID NO: 428475 - DNA, 2498 bp, Homo sapiens
aaacggatcgcgttgggtgaaggtgacggcgtcgagccattgacttccaaagactcctggcacatgaggaagaaacccagaagaggagagcaaaggagtcaggaatggcttttactcagttgacattcagggacgtggccatcgaattctctcaagatgagtggaaatgcctgaactctacacagaggactttatacagggatgtgatgttggagaactacaggaacctggtctccctggatccatctgtgatagcctctcttcttatccaagcaaagggctgagattcttgaaaagccacagcacatcatgttccattcattttataagcgggaaattctcttcctgaccagagtattatcctatgtgggagcacaggaaagagccctggaccatagaaagccaagtacgagtagcaagaaaaccaaaagggtgggaatggatcaaaggtgtgaaaacagatctgtctcgtaactgtgtaatcaaggaactagcaccacaacaggaaggtaacccaggagaagtattccacacagtgacattggaacaacatgaaaaacatgacattgaagagttttgcttcagggaaatcaagaaaaaaatacacgactttgactgtcagtggagagatgatgaaagaaattgcaacaaagtgactacggccccaaaagaaaatcttacttgtaggagagaccaacgcgatagaagaggtataggaaacaagtctattaaacatcagcttggattaagctttctaccacatccccatgaactgcagcagtttcaagctgaagggaaaatttatgaatgtaaccatgttgagaagtctgtcaaccatggttcctcagtttcaccaccccaaatactttcttctaccgtcaaaacccatgtttctaataaatatgggactgatttcatctgttcttcattactcacacaagaacagaaatcatgcattagggaaaaaccttacagatatattgagtgcgacaaagccttgaatcatggctcacacatgactgtacgtcaggtaagtcattctggagagaaaggatataaatgtgatctgtgtggcaaggtctttagtcaaaaatcaaaccttgcgcgtcattggagagttcatactggagagaaaccatacaaatgtaatgaatgtgacagaagtttcagtcgcaactcatgccttgcactacatcggagagttcacactggagagaaaccttacaaatgttatgagtgtgacaaggtcttcagtcgaaattcatgccttgcactacatcagaaaactcatattggagagaaaccttacacgtgtaaagagtgtggcaaagcctttagtgtgaggtcaacacttaccaaccatcaggtaattcatagtggcaagaaaccttacaaatgcaatgaatgtggcaaggtgttcagtcagacttcaagccttgcaactcatcagagaattcacactggggagaaaccatacaagtgtaatgaatgtggtaaagtcttcagtcagacttcaagccttgcaaggcattggagaattcatactggagagaaaccttacaaatgcaatgaatgtggtaaggttttcagttacaattcacaccttgcgagtcatcggagagttcatactggagagaaaccttacaagtgtaatgagtgtgggaaagcctttagtgtgcattcgaacttaactacccatcaggtcatccatactggagagaagccttacaaatgtaatcaatgtggcaaaggcttcagtgtgcattcaagcctaactacccatcaggtcatccatactggagaaaaaccttacaaatgtaatgagtgtggcaaatcctttagtgtgcgcccaaacctcactagacatcagataatccatactggaaagaaaccttacaaatgtagtgattgtgggaagtcctttagtgtgcgcccaaacctcttcagacatcaaattatccatactaaggagaaaccttataaaagaaattaatatggcaaggtcttcagtcaaagtttaaatcctgtgagtcatcaaagaatttatatcagagagaaaccatacaagtataataaatgtggcaaggttttcagtcacaattcactcctacacagcatcagagaatttcattcttgagagaatccttacaagtacagcaaacccttcatcacaagttcaagcattcattgacatcagagtccatgctaaagagaaatcatatacacctaactgtgtggcagaggcttcatttaggtctcacaactcactagacatcaaaatgtgtaaacatctttgtatattttgtgcatgttgaagctattaaccaaggatcaaaactgtaacacatccaaggatttatgtgaggaataattcagtctagttgtgctgataaacttttcatattacacattgtagaacaaatgcaagcccaaatgtgttaaaactcacacaacatgatatatattaaaggttgcaggatgtttgaagtcaaaaaaaa

SEQ ID NO: 428476 - DNA, 1794 bp, Homo sapiens
accttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattga

SEQ ID NO: 428477 - DNA, 845 bp, Homo sapiens
accttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagcttttttttttttttttacgagcaaccagttatttttttaaaaaggaaaaacccacccctttttaacacccttttttgg

SEQ ID NO: 428478 - DNA, 1991 bp, Homo sapiens
accttttgtgcatctttctttgaagccttaatgggaacctgatgggtttgctgtagcagcttccttgtgaattctgtcagagctgcaacagccgctgcactgccactcagttttctaaggaactcctcctactaccatcttggctcagtctccctcacttaagccctgggtttgaaaaattaattgcaacttcccaggaaacattgttcagtttgcagattaagcctggcactcacctatcagaaaccagagctccgcctgcttagttgtttcaaagttttctgaaagaaaactaggggagcacttgtgaacacaggagcagctggtgatctgctttcttaccctaactcttgacaaatgagtcgtctactattttaaagagtctggaggtctctgactctgccataacaataacctgctgttaatttataacacagatttttgtttggaagagccttatttgaaatacactttgatttattttcttaaatatttatattcttttcttgcttacttcagggttggtagcttagttggaagtgccagcacctggcacctattcatatagaacaggctgtactcaagacaacttctagcatttactttaagacttatataatttatttctattttgtgtgtactatagtcttgtgcatatgtagttgaacacacagtgaaatatatgtctctctttgtggatgtgcggcctaaaaatttgaatgtctggtgagagagagccatgtgtataggtcagagaaaagaacagctcccgactccctattagcgcctgtgatttgtttccttttgtgtttatctggcctagtgtgctgtttctttaaaccaggaagaagttttgtcttttggaggctcttctcacctgtccagcctggcatgtcagagaacacatagcctgtgacaatgccgtttttaaaggtttacttaatttgcagtaaatccagctgcctcaagaactcctacaccaagatggacatttcctttccagaaatgggatcaagtatctgctcactttggtattggatggactaataatgtagctccaaaaatgcaaggatggaagaatatgtgtaatccaaaccaaggaaggaaatgaaaagtgaacgtactgtttttaccacccctttctgtttgcttattgttggttgcttcactgtgcataaagttgttttcaatgcaacgcttgttaaataaatattgtgaactattttgtaaatgaaatgtattatgttgaaagctgtcagttcaaaaataagcttttttgttgttgttgaagatgaagtgtgttaggtgaaaccaaaaagccaaaaaaagtaatttcatatatagcatctatttgaatataatctttctttaaaatttcttttagcatagcattttcagtgctaagaaagaatctctatgttatattttgttaaaataatggctttctaacaaagcaaatggtaaagtacaaagttggaagatgtcaagttaacgagacttgctgcaaagccttgcagaacggaggaggctctgcctgctggctgtctctccctccaacctctctacaatcatgcctgctttgaggtgttctgttgcagcaagctgcaccttgggtcactcttttggaatattttgactataggctgcgtcacaggcagaaaaggagttgatggaaaatggactaaaaaactgacatgtttgaatcagtgctagagggaacagattgtgaattttgtttacagcatccaatatttggatttttttgtaaataaaaaagttatttttttctattgaaaaacaacacaacacaacaataacaacacacatctaaccaaaaaataaacaataacaaaatacacacaaacaaaaataaaaaacaacaaataaaacaaaacataaatgaacacaacagcaaaccactaaacaacagtcactcacacaataataacacctaacacgtcttcaacgccatgcaccacacatcacttttg

SEQ ID NO: 428479 - DNA, 3088 bp, Homo sapiens
  misc_feature (3088)..(3088): n is a, c, g, or t
aagcggagtgtgagggattttggaagcacttgccccaagcagagtttaaaatggagatggcaaatgaagcacagaaatctctttgctctggaaactggggtcccaccctggggacttctttgggtgagaagttgaagagtcgggatggatgagatgacctttcacatctggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcgttgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaaggtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagcaaaaaaagtaacaccgaaacaccacaccaacaaacaaacgggggggcgcaaagaaacccagagggcccagtaccgccccggttggtaccaggggcccacgtgaacgaataaacgcagcacggcggcgcaaaccggcgagggaacgcacggggcattggagacacccgggtgaccgcaccaccacggtaacgcggcacataggcaggacagcctggccagtgaggataagcacagacaaaagaggagaaacgcacacagaagaagccaaggcgacaaaacgagn

SEQ ID NO: 428480 - DNA, 2303 bp, Homo sapiens
  misc_feature (2303)..(2303): n is a, c, g, or t
aagcggagtgtgagggattttggaagcacttgccccaagcagagtttaaaatggagatggcaaatgaagcacagaaatctctttgctctggaaactggggtcccaccctggggacttctttgggtgagaagttgaagagtcgggatggatgagatgacctttcacatctgtgagtttttttcaagagaacaagttcctgctgaatggcctgtttctactctccaagctgctctcattttaccagactgcccccatcctggcctgcctttgtgggttcaaggaaggacctttgtctcaaacagctccccagctagtttgacttcttgccagaagtaatacccctccccgaaatatgtgccatccctttgcttttacccaggtgtcacctggttcccaccctcccttccccaatcctgtcccagggttaccagagatgtgacgaaaggacagtgctccagcgtcagaggtcaagcccaggctttggccataagcaagcctcagggtagggctaaaggctagagtcagggctcacacttgccagagcccaggtcagaggtcagccaggaaccagaatgcaattcttagcttatactcagccttagtgctcagtctaggggcaggggcagtgtgcttagtgggtggctaaattctagttttggtaggtacatgggtctgcatttcccagtagctcacacactcacagttgagatgagatgactcaggtcttagaaacctagctatagcagagtgacccaggacctggatgggctaaatccatggtgatacaggggtcacccagtaagccagtggtagagctgggactagaacccaggactcctgcctctgagcctagggccctgatcactgtctcccaaaatttgttctgaatctgggatccttaaattctaggaggcaaagtaaatttgcctgagctctagatgggccctcctgggtgcatctgactatactcttctacctcccagtgccaggcacatagtagttgctagaggaatgtctactgagtgtcaggtgcaacgggaggagccagtggcttgttcagatttggggctggaggaggctggcttgaggggaaggatctccagctgttgtcagaggaagcgacgccctcattggcctgccgccctccccctcctccagtgcttgcagccacactcagaagccgcccagctggcagcgggagggccctttcctctttcagggtgaaaaaaaaggaaaggacatttttggtagaaaagttccctgctgctccctggggattcccggtggccggatggactacgggatatcccagaggaagccgaaagccacccccgacccccctccaccctgcccccagcacaatgctgcgaggctctcccacgttgcaccagctggccaagggggctcccagaggtcatctcgtccaagcccctgtctgctggtgggcctgcagggagcctctgcgacctctctcgtgaccaacagcaagtctgaggggcacctgtttagagcccaggcccagctctgcaatgaaagcagaaaagagacaaagcaagatgggaggactgtgggggcttagcaagggggactaacatagcctggaaagagggcggggcactggacctaggggctgaggacttagattccaggcagaggatgcagaggttgagcaaaggctgagaggtgacagggaaatgatgaattgggaagtcagagcccagatgataaggccttgaccgccagctcccctatgcccttgtccctggcagggtatcctcaggtccgagcccctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagcaaaaaaagtaacaccgaaacaccacaccaacaaacaaacgggggggcgcaaagaaacccagagggcccagtaccgccccggttggtaccaggggcccacgtgaacgaataaacgcagcacggcggcgcaaaccggcgagggaacgcacggggcattggagacacccgggtgaccgcaccaccacggtaacgcggcacataggcaggacagcctggccagtgaggataagcacagacaaaagaggagaaacgcacacagaagaagccaaggcgacaaaacgagn

SEQ ID NO: 428481 - DNA, 830 bp, Homo sapiens
tcttctggggcttgtccctcaggggtgaaggactcagctcatgattcccaaggcgttcatttattccttcactcacccattcattcattcatcaagtgggttttgagttcctgctatgtgccaggagctgaggatatgggagtggataggacggtcccgatcccttattgggtcccgggacaagtgtgacgcagacgattctaggagggcaaagaaaccacccttatctagcagctcttgtttctgctccagaagaagccgagcgttttcccattttactgtctgggaacttgaggctgcctccttggtggaggtccaaggaagcaccgagagggcgggcagctcagttagtcctttgtccaaggggaagctgggagccccatatggactttccgggaaggtgggggcgagtgcgtctgtgtactggagtggaggggagtcccctttctccgcccctccccgccccgtggccgcggcgtggcggggccggggcggagctggcgtcgcccggggcaggagggcagccgcggccggcaggacaggcagacggacaggctgacaggagagagaacaggcactgcgggacctgcaggagaaaggcgatcctgtggctgggaatgtgaccccacggccagaagaggacccgtgagtgtgcgccgtgcccctgcggcctcgccgcgcaccccgcccgcctggcttccactttcatttcttcggccgtcctggcgtggcacagtccggaggagagtcccgcccgaaggcaggctggccgctgtcctgaggctggcgtccgaggctcagagcttcgaaagttgcgggggggattgtcg

SEQ ID NO: 428482 - DNA, 3056 bp, Homo sapiens
  misc_feature (3056)..(3056): n is a, c, g, or t
cggggcaggagggcagccgcggccggcaggacaggcagacggacaggctgacaggagagagaacaggcactgcgggacctgcaggagaaaggcgatcctgtggctgggaatgtgaccccacggccagaagaggacccggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcgttgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaaggtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagcaaaaaaagtaacaccgaaacaccacaccaacaaacaaacgggggggcgcaaagaaacccagagggcccagtaccgccccggttggtaccaggggcccacgtgaacgaataaacgcagcacggcggcgcaaaccggcgagggaacgcacggggcattggagacacccgggtgaccgcaccaccacggtaacgcggcacataggcaggacagcctggccagtgaggataagcacagacaaaagaggagaaacgcacacagaagaagccaaggcgacaaaacgagn

SEQ ID NO: 428483 - DNA, 4688 bp, Homo sapiens
  misc_feature (4688)..(4688): n is a, c, g, or t
aagcggagtgtgagggattttggaagcacttgccccaagcagagtttaaaatggagatggcaaatgaagcacagaaatctctttgctctggaaactggggtcccaccctggggacttctttgggtgagaagttgaagagtcgggatggatgagatgacctttcacatctgtgagtttttttcaagagaacaagttcctgctgaatggcctgtttctactctccaagctgctctcattttaccagactgcccccatcctggcctgcctttgtgggttcaaggaaggacctttgtctcaaacagctccccagctagtttgacttcttgccagaagtaatacccctccccgaaatatgtgccatccctttgcttttacccaggtgtcacctggttcccaccctcccttccccaatcctgtcccagggttaccagagatgtgacgaaaggacagtgctccagcgtcagaggtcaagcccaggctttggccataagcaagcctcagggtagggctaaaggctagagtcagggctcacacttgccagagcccaggtcagaggtcagccaggaaccagaatgcaattcttagcttatactcagccttagtgctcagtctaggggcaggggcagtgtgcttagtgggtggctaaattctagttttggtaggtacatgggtctgcatttcccagtagctcacacactcacagttgagatgagatgactcaggtcttagaaacctagctatagcagagtgacccaggacctggatgggctaaatccatggtgatacaggggtcacccagtaagccagtggtagagctgggactagaacccaggactcctgcctctgagcctagggccctgatcactgtctcccaaaatttgttctgaatctgggatccttaaattctaggaggcaaagtaaatttgcctgagctctagatgggccctcctgggtgcatctgactatactcttctacctcccagtgccaggcacatagtagttgctagaggaatgtctactgagtgtcaggtgcaacgggaggagccagtggcttgttcagatttggggctggaggaggctggcttgaggggaaggatctccagctgttgtcagaggaagcgacgccctcattggcctgccgccctccccctcctccagtgcttgcagccacactcagaagccgcccagctggcagcgggagggccctttcctctttcagggtgaaaaaaaaggaaaggacatttttggtagaaaagttccctgctgctccctggggattcccggtggccggatggactacgggatatcccagaggaagccgaaagccacccccgacccccctccaccctgcccccagcacaatgctgcgaggctctcccacgttgcaccagctggccaagggggctcccagaggtcatctcgtccaagcccctgtctgctggtgggcctgcagggagcctctgcgacctctctcgtgaccaacagcaagtctgaggggcacctgtttagagcccaggcccagctctgcaatgaaagcagaaaagagacaaagcaagatgggaggactgtgggggcttagcaagggggactaacatagcctggaaagagggcggggcactggacctaggggctgaggacttagattccaggcagaggatgcagaggttgagcaaaggctgagaggtgacagggaaatgatgaattgggaagtcagagcccagatgataaggccttgaccgccagctcccctatgcccttgtccctggcagggtatcctcaggtccgagcccctggacagcagccccaggcccagctggccatggccctgtgcctgaagcaggtgttcgccaaggacaagacgttccggccgcggaagcgctttgagccgggcacacagcgctttgagctgtacaagaaggcacaggcctctctcaagtcgggcctggacctgcgcagtgtggtgaggctaccacccggggagaacatcgacgactggatcgccgtgcacgtggtggacttcttcaaccgcatcaacctcatctacggcactatggcggagcgctgcagtgagaccagctgcccggtcatggccggcgggccccgctacgagtaccgctggcaggacgagcgccagtaccggcggcccgccaagctctctgcgccgcgctatatggcgttgctcatggactggatcgaaggcctcatcaacgacgaagaggtctttcccacgcgtgttggagttcccttccctaagaacttccagcaggtctgcaccaagatcctgacccgcctcttccgagtctttgtccatgtctacatccaccacttcgatagcatcctcagcatgggggcagaggcgcacgtcaacacctgctacaagcacttctactacttcatccgcgagttcagtctggtggaccagcgggagctggagccactgagggagatgacagagcggatctgccactgagcccaggtctggacttttttggccatcagatggacgatctgaacatagggtggctggcagaggggacccccaggagcctgaaggaatctgaaggcactggaatcactccacacacccaaagcctctggacttctggttctcaggagtctgcctacctgtcgccctgaccgcttgtggatggagaaggggagagcatctaggcaggcaaacagaagggaagtggagttaaacctctggcatgaagtctgggagtagggtaggctagggggtttcttctatgacacttgacccttccatgctggttcccaagcctattggaggaatgtgggtgtggccgaggtgatggcaagaaaggtgcaagaaagtgagcagtctgcctgtgagtgagcacagatgccggggtgtgtgtgtgtgtgtgtgattttcactgtggggtgtgtctgtgagagctagctgccttacccctccttggcacatagtaggccttccataaatgttggatggatggataaatagattgggaccatcagaccatgggaccatcagaccatgaccactgtaggagtgatgacagctcagcgtccccactcagtgtatctgaccatgtgtgtaagtgcacaaaaatgtggttgtagatgttgctctacattcaaaccttccaggctacactcttccatcagcatgagtcctggagagctgggggaaggtaggaagaggagccttgccttgagttcctaaaccgacccactgcagacacaggctctgattctcttacccagagatgcccatgagctgacattttactcatccctctgcctccaagaaggcctgtattatacgtgtcctcctgggggttggagatgatccctcaagtacacaaaggtcccctggcccttcatctgggaatcatatactccactctagctcccagaatctacagacctggctcctcggatctgaagcccagcacaaaataatctccccgtccaaggagcttgtggaacttgaattgggaactttggagtcttgtctcccatcccagcacattgaggatgtagttggtgaatggactcttccaggcatggagatcctccatcctaaaagtacctgcctccttcccagccatccctgacacattccagccagttggatctcacagcacagctatccacagggagactgggatgttcacgcagcactccattactcagtacctccatacccagccctatacgcagacccacaggtggggaaactgaggcaggaacagggttctgccctcccagagcctccactctgggatgccagaatggaaagccagagggaacctgagaatcatccagtcttactgtctcaatgtacatacggggaaactgaagccaggagaagaagagggagaaactgtccagggcctcacagggaggcattcatggagctggagaaaccagggatcctgaccgcagggcccatcaattgctacatagagatacacatggaaagagggtttaacagaccctctctaggacacaactgtttctgctttgagcaataatttctaacctgaggccaacatgtcccactgccccttgggttggctggggttgtttcctgagccaagcatccaatatcatgccccactcaatggcctagaagctgcctgtactttggggaaacagatggagctcttgggcccagccagctgggcctgggacttctgcctctgccgcctccagagtggcctggcagctttgccagaggctgtggagcgagggtagtaggagcttttcccagagtgctgtgacttgcatgatggattctaggctgtggcaagggctgatttctgggatagggggagggttggaaaatttatttttatgaaacagagggaagactttattgttgttatttttggtaaaataaaaggcaaactaaagcaaaaaaagtaacaccgaaacaccacaccaacaaacaaacgggggggcgcaaagaaacccagagggcccagtaccgccccggttggtaccaggggcccacgtgaacgaataaacgcagcacggcggcgcaaaccggcgagggaacgcacggggcattggagacacccgggtgaccgcaccaccacggtaacgcggcacataggcaggacagcctggccagtgaggataagcacagacaaaagaggagaaacgcacacagaagaagccaaggcgacaaaacgagn

SEQ ID NO: 428484 - DNA, 3000 bp, Homo sapiens
  misc_feature (346)..(346): n is a, c, g, or t
  misc_feature (1151)..(1151): n is a, c, g, or t
cgtggaaagaggttggcgcgctggaagtccagttgcttcggctccctgcgttaggtctggtggcggtcaatgcgcttccggacccgggatcagagtgtgtggatcgctatagggggaggggagctcagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaancggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcnacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggctttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattat

SEQ ID NO: 428485 - DNA, 2910 bp, Homo sapiens
  misc_feature (256)..(256): n is a, c, g, or t
  misc_feature (1061)..(1061): n is a, c, g, or t
ctgtttgtccaccttccagctttaacgctctgcaacagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaancggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcnacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggctttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattat

SEQ ID NO: 428486 - DNA, 3084 bp, Homo sapiens
  misc_feature (346)..(346): n is a, c, g, or t
  misc_feature (1151)..(1151): n is a, c, g, or t
cgtggaaagaggttggcgcgctggaagtccagttgcttcggctccctgcgttaggtctggtggcggtcaatgcgcttccggacccgggatcagagtgtgtggatcgctatagggggaggggagctcagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaancggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcnacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggctttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaataccctcaaattaacaattcaattgcatataatagcctaactcagtaagaatattaaaacttactattattaaaaaaata

SEQ ID NO: 428487 - DNA, 1163 bp, Homo sapiens
  misc_feature (137)..(137): n is a, c, g, or t
  misc_feature (325)..(325): n is a, c, g, or t
  misc_feature (331)..(331): n is a, c, g, or t
  misc_feature (570)..(570): n is a, c, g, or t
gttagtgtttctgagagcaccttagtgttgctctgcctcagccagctgggcaaggagttggggagcggggaggaggccggcgccatggagtggggaagggagccgtcactgttggggatcagccgctagtgtaaacnagcatctccacccacccagataagccccccacccaagtgtggagccctgctcagggagtacctcaagggccccggcctgggtggcgccagcaggcttggacactgccctggcagcaggggccccgtggaaggcaggatacccagcagggggtgccacccagtgtggatggaggggcagggcgggggcncccctnagtcactgggcagaggcacgagcacgtccacatagctgagcaggaagaagcccgactggccgtccagcatgccctcgtatcagttctcgttcatctggttgatcagcatgaagacatcgccctcatggaagcccagctccctatctttctccggctccaagtcatacagcccttgcagctcggctggtctaggggcggcatgctcctgctaggagtccagatggacttgtcgtaagatnggaaagaggacgaagctgcgatgttccggacgtgtgggtgcaggggaagccccggttggactgctcaggctttccgaggtcaaagcactcccggggcttgggcttatactcccgcctgggtcgtgaggaagcttcccggatcctgcacttgaacttctgggccagctggtccaggatctgcacggcctgccggtggtagtccagctgcgcctctgccaaggccgggagttgactcacctactggatgtcggtctccaggaggttgtgcatgctggtttctgccacctccttggactcctcaaacttctccagcgcctggtgcagctcctcttcggggatcttgccctgccgcttcttttagtcaaagtccaggcggcggccctccagcttctgcaggtggtgctggatctccttcaggtctttctcacataggttctggagggggtcaatgaagttatgcttgacctctatgtccagggagtccttcacctctgccaggtgcttcatgggctcgccggcatccagcagtgcatcgctgaagttggacgcacatcgtgcagtttcgggatcctctagattacccagcaacacgt

SEQ ID NO: 428488 - DNA, 1650 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccaggttcatgttgctgaggaggcagagggctgagttcttccatccatcgccttcaagtgtcaggcggcttccggttggacaagatggctaccccagtgggcttgtttcctctctggtctctttttctgtctaagactcactccataccagcctgagcttgggaccattgttttgctcctctcatcctcctacccccagagctgacagatttagcaaataaaatttacaagatcctgttaaattaagaatttcggacaaacaacaaactaccccacactgtctcaggagggtccctcagagataagtgtcactgagcctcgggaaggaggaagctccatccctgcccatcaagccccctcttgggtcccctcaaggaagacagtggttccagaaggtgtgttcccaccccctttcacagcctacctctctcccatccctctctgaccccaggttccagctggcctggggatttctgggaggatccgaagaacaaggccatctgcagtaggagcctcctgttcctcgccacctacgcttcagccctgcccaactaacagctctccatgttctaaagaaggcaggagtgctggaccaccccagccttctggaaccccagttctgtgacattatccatctcctggaaatatgctggttttaaccatgcaaattagttaagcatcaggcagaaatagcagctgggcctggaagcacaggtgacgtctgtgaggaaaatggctgggtgggacagggtggagagcacgggctgttcccttcctttctgggaacagcaccacctttggggtaactccttctctcatggggttttaggcgggggctgccagtgccagtgcccggtcccctgtcaccccccatagtcataggaacgcttctgcgccagtcactacatttataaggggaagctggtggagctgctcagcttccaacaggaagcccatgtgtgcagggccagaggacacagcccatctgaggtgctaagcttctgtgaagagggagtggagtctggaccggattccagtcccacggtccaccctttctgggac

SEQ ID NO: 428489 - DNA, 681 bp, Homo sapiens
tttgtgtgagcaacaaggttgtttatttcacttgggtgcaagtggactgagtccacaaagagagtcagcaaagggagatggggtggagcagctttataggatttgggtaggtggtggaaaattacagttaaaggtagttatctcttgcagacagggcaggggtcacaaggtgcaggatggggagatcatgagactcattgtccaggggaggaatgtcacaaggccagttgattagttggggtggggcaggaacaaatcaccatggtggaatgtcatcagtgaaggcaggaactggctgtttcatttttttggtggttcttcagttgctccaggccacctggacgaatacctgcagatcacaggggttaacgatggcttagcttgggctcagcggcctgacattgaggatccttctttatctttttctgatgcccttctatgagaatgaatatgttttggaagaaaatgcaattaagattatccatcacaacaaccactatctccaaatctgtattcattgcttctattcattattcattataagtctcatctacctgatgaaataacttttttgaagataggaattgtatgctgtttaacagtgctttgattcttccacagttcagtcatccttgatatcttgcaggggattgttctagatacacgctgccacgccatacc

SEQ ID NO: 428490 - DNA, 1115 bp, Homo sapiens
gaaaatccttgaagaaatttccttcagaaaactcctgaagctgttagaatttttagtgttcatgttgctgaggaggcagagggctgagttcttccatccatcgccttcaagtgtcaggcggcttccggttggacaagatggctaccccagtgggcttgtttcctctctggtctctttttctgtctaagactcactccataccagcctgagcttgggaccattgttttgctcctctcatcctcctacccccagagctgacagatttagcaaataaaatttacaagatcctgttaaattaagaatttcggacaaacaacaaactaccccacactgtctcaggagggtccctcagagataagtgtcactgagcctcgggaaggaggaagctccatccctgcccatcaagccccctcttgggtcccctcaaggaagacagtggttccagaaggtgtgttcccaccccctttcacagcctacctctctcccatccctctctgaccccaggttccagctggcctggggatttctgggaggatccgaagaacaaggccatctgcagtaggagcctcctgttcctcgccacctacgcttcagccctgcccaactaacagctctccatgttctaaagaaggcaggagtgctggaccaccccagccttctggaaccccagttctgtgacattatccatctcctggaaatatgctggttttaaccatgcaaattagttaagcatcaggcagaaatagcagctgggcctggaagcacaggtgacgtctgtgaggaaaatggctgggtgggacagggtggagagcacgggctgttcccttcctttctgggaacagcaccacctttggggtaactccttctctcatggggttttaggcgggggctgccagtgccagtgcccggtcccctgtcaccccccatagtcataggaacgcttctgcgccagtcactacatttataaggggaagctggtggagctgctcagcttccaacaggaagcccatgtgtgcagggccagaggacacagcccatctgaggtgctaagcttctgtgaagagggagtggagtctggaccggattccagtcccacggtccaccctttctgggac

SEQ ID NO: 428491 - DNA, 5503 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaacagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428492 - DNA, 5467 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428493 - DNA, 5405 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacaggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428494 - DNA, 5639 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtctccctctgtcacccaggctggagtgtagtggcgcgatctcgggtcactgcaacctccccaagctgggctcaagagatcctcccacctcagcctcctgagcagctgggactacagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428495 - DNA, 4931 bp, Homo sapiens
ggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428496 - DNA, 5548 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgtgggattaactttgtttcaattcacagagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428497 - DNA, 5187 bp, Homo sapiens
ggccaacaatttttttaaaagatggttaccctgcagtgctttaactggacctatttagacaacgccttacacactggagaaggatgatactttgtgactctaataaatctaccagacaatacttctctcttttggctgtctccttcctctccagggtgatgacaactccgtgagggtggagattatacatctctcatcatttcagcaacaaggaaataaattagtggcagagtaagggtgacttggtgagtacatccaattgttgacatagttttgggtgggagaaattttgctattatatcaacttcttaaaatggtctagtgggattaactttgtttcaattcacagagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428498 - DNA, 4629 bp, Homo sapiens
ttttttttttttagaaaaaagttattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428499 - DNA, 4926 bp, Homo sapiens
tactactactaaattcgcggccgcgtcgacaataaattagtggcagagtaagggtgacttgtgggattaactttgtttcaattcacagagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428500 - DNA, 4244 bp, Homo sapiens
tagtctagatattatgtatacgggttcttcgaatgtagtaggtaaggtggggggcatccatatagtcactccaggtttatggagggttcttctactatataggactttttcgcttcgaagcgaaggcttctcaaatcatgaaaattattaatattactgctgttagagaaatgaatatcgaacagtgggacgtcccactgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428501 - DNA, 3091 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtcaggcgcagacgattatcatgattacggactcgctggccctcgttttaccctcaggaatcggctatga

SEQ ID NO: 428502 - DNA, 1859 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtctccctctgtcacccaggctggagtgtagtggcgcgatctcgggtcactgcaacctccccaagctgggctcaagagatcctcccacctcagcctcctgagcagctgggactacagggtgatgacaactccgtgagggtggagattatacatctctcatcatttcagcaacaaggaaataaattagtggcagagtaagggtgacttggttcatgttgctgaggaggcagagggctgagttcttccatccatcgccttcaagtgtcaggcggcttccggttggacaagatggctaccccagtgggcttgtttcctctctggtctctttttctgtctaagactcactccataccagcctgagcttgggaccattgttttgctcctctcatcctcctacccccagagctgacagatttagcaaataaaatttacaagatcctgttaaattaagaatttcggacaaacaacaaactaccccacactgtctcaggagggtccctcagagataagtgtcactgagcctcgggaaggaggaagctccatccctgcccatcaagccccctcttgggtcccctcaaggaagacagtggttccagaaggtgtgttcccaccccctttcacagcctacctctctcccatccctctctgaccccaggttccagctggcctggggatttctgggaggatccgaagaacaaggccatctgcagtaggagcctcctgttcctcgccacctacgcttcagccctgcccaactaacagctctccatgttctaaagaaggcaggagtgctggaccaccccagccttctggaaccccagttctgtgacattatccatctcctggaaatatgctggttttaaccatgcaaattagttaagcatcaggcagaaatagcagctgggcctggaagcacaggtgacgtctgtgaggaaaatggctgggtgggacagggtggagagcacgggctgttcccttcctttctgggaacagcaccacctttggggtaactccttctctcatggggttttaggcgggggctgccagtgccagtgcccggtcccctgtcaccccccatagtcataggaacgcttctgcgccagtcactacatttataaggggaagctggtggagctgctcagcttccaacaggaagcccatgtgtgcagggccagaggacacagcccatctgaggtgctaagcttctgtgaagagggagtggagtctggaccggattccagtcccacggtccaccctttctgggac

SEQ ID NO: 428503 - DNA, 1741 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttggttcatgttgctgaggaggcagagggctgagttcttccatccatcgccttcaagtgtcaggcggcttccggttggacaagatggctaccccagtgggcttgtttcctctctggtctctttttctgtctaagactcactccataccagcctgagcttgggaccattgttttgctcctctcatcctcctacccccagagctgacagatttagcaaataaaatttacaagatcctgttaaattaagaatttcggacaaacaacaaactaccccacactgtctcaggagggtccctcagagataagtgtcactgagcctcgggaaggaggaagctccatccctgcccatcaagccccctcttgggtcccctcaaggaagacagtggttccagaaggtgtgttcccaccccctttcacagcctacctctctcccatccctctctgaccccaggttccagctggcctggggatttctgggaggatccgaagaacaaggccatctgcagtaggagcctcctgttcctcgccacctacgcttcagccctgcccaactaacagctctccatgttctaaagaaggcaggagtgctggaccaccccagccttctggaaccccagttctgtgacattatccatctcctggaaatatgctggttttaaccatgcaaattagttaagcatcaggcagaaatagcagctgggcctggaagcacaggtgacgtctgtgaggaaaatggctgggtgggacagggtggagagcacgggctgttcccttcctttctgggaacagcaccacctttggggtaactccttctctcatggggttttaggcgggggctgccagtgccagtgcccggtcccctgtcaccccccatagtcataggaacgcttctgcgccagtcactacatttataaggggaagctggtggagctgctcagcttccaacaggaagcccatgtgtgcagggccagaggacacagcccatctgaggtgctaagcttctgtgaagagggagtggagtctggaccggattccagtcccacggtccaccctttctgggac

SEQ ID NO: 428504 - DNA, 1034 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtctccctctgtcacccaggctggagtgtagtggcgcgatctcgggtcactgcaacctccccaagctgggctcaagagatcctcccacctcagcctcctgagcagctgggactacaggtacaagccaccacagccagctaatttttgtaatttttttgtagagatggggtttcgccatgttgcctaggctgatctcgaactcctgagctcaagtagtctgcctgccccggcctcccaaagtgctgggattacaggtgtgagccaccgcacccagccagtgatttatttctgatattatatttactataagaattcttttctaaatatgaaaattagttttatataaatgtaggataaacactgtagctctctactgaaatgttttaaggatcattgtaattctgctttccctaatcttaaatccaaccaaaattaaattat

SEQ ID NO: 428505 - DNA, 5521 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428506 - DNA, 4089 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacaga

SEQ ID NO: 428507 - DNA, 4571 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagttgccagctcggcgcccgccccggcgccgcctcgagttcatgattctttagtctccttcaatctagatctgttcccaggattgtttaaaagcatactgacaaacctttgagactgtaaatgacctgaggtatacattatctttacttgagaatagtaatttttcaatatgcattaaagatcattacacatgagctaagaaaaatgagc

SEQ ID NO: 428508 - DNA, 5432 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacaggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgtgggattaactttgtttcaattcacagagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggat

SEQ ID NO: 428509 - DNA, 3393 bp, Homo sapiens
  misc_feature (9)..(9): n is a, c, g, or t
ggcctcagntgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatgga

SEQ ID NO: 428510 - DNA, 1770 bp, Homo sapiens
  misc_feature (137)..(137): n is a, c, g, or t
  misc_feature (325)..(325): n is a, c, g, or t
  misc_feature (331)..(331): n is a, c, g, or t
  misc_feature (570)..(570): n is a, c, g, or t
gttagtgtttctgagagcaccttagtgttgctctgcctcagccagctgggcaaggagttggggagcggggaggaggccggcgccatggagtggggaagggagccgtcactgttggggatcagccgctagtgtaaacnagcatctccacccacccagataagccccccacccaagtgtggagccctgctcagggagtacctcaagggccccggcctgggtggcgccagcaggcttggacactgccctggcagcaggggccccgtggaaggcaggatacccagcagggggtgccacccagtgtggatggaggggcagggcgggggcncccctnagtcactgggcagaggcacgagcacgtccacatagctgagcaggaagaagcccgactggccgtccagcatgccctcgtatcagttctcgttcatctggttgatcagcatgaagacatcgccctcatggaagcccagctccctatctttctccggctccaagtcatacagcccttgcagctcggctggtctaggggcggcatgctcctgctaggagtccagatggacttgtcgtaagatnggaaagaggacgaagctgcgatgttccggacgtgtgggtgcaggggaagccccggttggactgctcaggctttccgaggtcaaagcactcccggggcttgggcttatactcccgcctgggtcgtgaggaagcttcccggatcctgcacttgaacttctgggccagctggtccaggatctgcacggcctgccggtggtagtccagctgcgcctctgccaaggccgggagttgactcacctactggatgtcggtctccaggaggttgtgcatgctggtttctgccacctccttggactcctcaaacttctccagcgcctggtgcagctcctcttcggggatcttgccctgccgcttcttttagtcaaagtccaggcggcggccctccagcttctgcaggtggtgctggatctccttcaggtctttctcacataggttctggagggggtcaatgaagttatgcttgacctctatgtccagggagtccttcacctctgccaggtgcttcatgggctcgccggcatccagcagtgcatcgctgaagttggactcgtcgcgcagctccttcccatggcggatcaggcactcgcccaggagcccccctgactgcaggtagccggggttcttcacctggccccggatcttgcacgcggtgttgagcatggtcagtttagcctgcgaggctgggttgggctgcgggtactcgatggtcctggacagtacttacgtcaccgccttgctgatgacatccaccttctccatctcttcgaagtcatcatccagcttggtcccctcagcccctccgaccttctcactgaccagttggctcgccttgtagaactgcttcttcagcccggcaaccgacatgctgcctcctgccgcggaaccttccgcccagacccccctgcccagaccccgccagcgacaggctcccgggcaccaccaaccctctgcgcgcctcagcggcccccatcagcaccgcctccaccacccgcttgccagctcggcgcccgccccggcgccgcctcgagttcatgattctttagtctccttcaatctagatctgttcccaggattgtttaaaagcatactgacaaacctttgagactgtaaatgacctgaggtatacattatctttacttgagaatagtaatttttcaatatgcattaaagatcattacacatgagctaagaaaaatgagc

SEQ ID NO: 428511 - DNA, 599 bp, Homo sapiens
aaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaaaaaaaaat

SEQ ID NO: 428512 - DNA, 319 bp, Homo sapiens
tgtctgcttatgcggtggctcgctgctcagaacaggatggcagagatgagcaccaccatcaaaaactcaaggaccagtgctgtgggtccagtcatctgtttcatggaattcaccagtctggtatcttcaaaatccagaaggatgatggcagatggcaggaaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctgga

SEQ ID NO: 428513 - DNA, 1060 bp, Homo sapiens
tgtctgcttatgcggtggctcgctgctcagaacaggatggcagagatgagcaccaccatcaaaaactcaaggaccagtgctgtgggtccagtcatctgtttcatggaattcaccagtctggtatcttcaaaatccagaaggatgatggcagatggcaggaaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggaaccattggagatactcattactctttgaaggcttacagtggaatgaattcaaatacgacttatttgaggaattgaagttgactttatggagctgataagaatcttcttggagaaaaaaagactggtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaaaaaaaaat

SEQ ID NO: 428514 - DNA, 1181 bp, Homo sapiens
tgtctgcttatgcggtggctcgctgctcagaacaggatggcagagatgagcaccaccatcaaaaactcaaggaccagtgctgtgggtccagtcatctgtttcatggaattcaccagtctggtatcttcaaaatccagaaggatgatggcagatggcaggaaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccag

SEQ ID NO: 428515 - DNA, 2003 bp, Homo sapiens
cgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggtgcgtcaggcgcacgtgggcgccgtctctcagccttggccaattagcgcgcgcctagtgcgtcacgtgccgggccgcggggtcctcccctccctccctccctccctccctctctccctgttggagtgggcgtgggcggtgctgtgcggggtcgtcacgtggtgtgggcggtgcaggggccacgggactcacccgctctccagcctgcgcctggggttggaggtgcccagcgcgccgcctcttaactcgggggtgacgctgcccgtttcccaggtggggccactgaagccggagcatgccgggcaggggtcaggccctggcggggcgagggggcctccttggctccttgtcgccggatgcccgtcctcgttctcatcttcccgcctgccgccaggcctttccgtggggtcccgatattttcctttcttgcttctcccgggtgggagagacacagcgaggaccttatccctccccatcaccaccctggcaaagtcaagccgctttttattttttataagtttttattgtagcgatggggtctcgccatgttacccgcgctggtctgaactcctgggctcaagtgatcctttttcgttggcctcccaaagtgctggcattatagatgtgagcacctgcactccgccatgctgctttttatgggccctgtgcagagcctcccctgtgctccacacctcttcctgtggaagcacctgctgcgcgctctcccctgcctgtatgccgcgccctccctgcctcccgggctgctggggccaccaggggcttggccctgagacaggcttccattctgttgtctttggcaaagtctcacccctgtgtgagcctcagtcttttcatcagtgcaatgggagtgacatcagcgtgcctctcctggggtcctggcgcaggggagatgggagggcctggtagggcacatgtcttcttactgtcatcgccatgggagtgaatggtaatcacttggcgattaggacatgaaagaagcaggcacagcaaaaccagggaggtctgcagcagggctcggggctccagtagaggacggcaatgagagtcctgagggaaggaggaggcagggttggcggggaggggccactgactatgcctggacctacttccaggttgaagaagcctcagcggaggcgatacggcctcctcgccaacactgaggaccccacggagatggcctcgctggacagcgacgaggagacggtctttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgc

SEQ ID NO: 428516 - DNA, 870 bp, Homo sapiens
cgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggttgaagaagcctcagcggaggcgatacggcctcctcgccaacactgaggaccccacggagatggcctcgctggacagcgacgaggagacggtctttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgc

SEQ ID NO: 428517 - DNA, 1143 bp, Homo sapiens
cgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggtgcgtcaggcgcacgtgggcgccgtctctcagccttggccaattagcgcgcgcctagtgcgtcacgtgccgggccgcggggtcctcccctccctccctccctccctccctctctccctgttggagtgggcgtgggcggtgctgtgcggggtcgtcacgtggtgtgggcggtgcaggggccacgggactcacccgctctccagcctgcgcctggggttggaggtgcccagcgcgccgcctcttaactcgggggtgacgctgcccgtttcccaggttgaagaagcctcagcggaggcgatacggcctcctcgccaacactgaggaccccacggagatggcctcgctggacagcgacgaggagacggtctttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgc

SEQ ID NO: 428518 - DNA, 898 bp, Homo sapiens
cgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggttgaagaagcctcagcggaggcgatacggcctcctcgccaacactgaggaccccacggagatggcctcgctggacagcgacgaggagacggtctttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgcaaaaaaaaaaaaaaaaaaaaaaaaaaac

SEQ ID NO: 428519 - DNA, 1023 bp, Homo sapiens
cgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggttgaagaagcctcagcggaggcgatacggcctcctcgccaacactgaggaccccacggagatggcctcgctggacagcgacgaggagacggtctttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgcaaaaaaaaaaaattaaaaaattaaaaaaccttaatgataatggaaaataaaaaaaactcaggggggggccggttccaaattccctattgggagcctttacaattcaatgcccggctttaacaactcgtattggaaaaacccggtttcccaatc

SEQ ID NO: 428520 - DNA, 893 bp, Homo sapiens
cgccaccgcttccgccgggccatggggccgcgcgtgctgcagccgccgctgctgctgctcctgctggcgctgctgctggcggcgctgccgtgcggtgccgaagaggcctcgccgctgcgccccgcgcaggtcacgttgtcgccgccgccggccgtgacgaacgggagccagccgggcgcgccacacaacagcacgcacacgcgtccgccgggggcgtcgggctcggcgctgacgcgctccttctacgtgatcctgggcttctgcggcctgaccgcgctctacttcctgatccgggcgtttaggttgaagaagcctcagcggaggcgatacggcctcctcgccaacactgaggaccccacggagatggcctcgctggacagcgacgaggagacggtctttgagtcccggaatctgagatgatgctgagccagggaggcggcccttccagcagccatgagggaaggacaggagatggggcccaccccagtgcccagcaaccccctgctccaccgctcattcccctgctggccccggggctggtctcacccagtgccaacccgagagctccttttggaacctgcacagcccgccgacctgttgccacctgcacccaccgctggaccatgcagcctcgcctcctggatgctgtcccagcctggccgagggtcccaggtgaagactggagggaccccaacagccaccgcccaggacgctgaggctcccttgcctgactgtgacttgtgcctctctcctgcccccgtggggacatggcagcccagagccaaggctgggtgggcaggtgacccaaggaacctttctgggaacaccttctcgccgggctgggaacaataaatgcagccatgtctctgcagctggtgctgaccccatgccac

SEQ ID NO: 428521 - DNA, 437 bp, Homo sapiens
ctcctgacctcaagtgatctgcctgccttggcctcccaaagtgctggaattacaggcgtgagccactgtgccttcccatggtttcttatacttattttaacaatgttatttttgctttaaccatttcaaatatcaaatttctggtagatctgagatactttcaagtttataggacaactggcatctcaaacttgaagtatccaaaatggggctctcttgtcatctccaaccttggtcctcacctgcttttcctctattccaacagttactcaaaataaaaatttaagacttgtctttggcttctctttttcttcatcaatgccttcacactccttaccctgaacatccaatctagcagcaatttgtgttttttctgggaaggaggggagtccaaaatatatattgaattaatctatttcttgctttctctacagcca

SEQ ID NO: 428522 - DNA, 1459 bp, Homo sapiens
tccaccccctccccagagcactagtcatgccgcaaatgctaggaagtgccattttcattttctccactgtgcgtgtgtgctcaagtctttcgctctcacgtgggtgtacatgtgtgtgagcgtgtgtgtgtctctctctaaagcatgccaagggaatggtccatgtgtacatagactcattgtgctgtagatactgtcctgcattgtaattgtgagatgcggctgtaacaagttgctgggggagatggcggggaaagaggcaaggagcagagtcctccctacatccatggctgtcacatggcatcagtgtgtattcaaaccaagctatgctccttccaagggcaggaccccatattcctcctagtcccatcatcagaaccgagtggggagtcactcagaatatcactgtaaatgaaagtgcctactatcgatggggtaagcaaacagcataaggaattatgacgtggacgaggtgacctaggagagaaaatttcagattttactctcatttcatgagtctgagggattcttatatttcctggcatttaacagggtaggccctgctccactgtgaaaatgagcagcatgtgttgagtaaatccccagaaacaggaaggtctccaagtgtcaactcccagtgaaagaatgatgaaccacttggagatcctaagcagccctgttttacctcctccctaatcttaaataacatttgtcccatgaattcccctgagcagagattgtttcctatttcagataaaatacagtgaaagtgagcaaggcagaaaaagtcaacagatgcccaggctcctactgtattctggagatactgtcagagctctaatacagagcactggccataatgaaaagcagttcactccttgtgctcctctgcagatgtttttcccagtgttctaggttaatgttttatttggttgcctgcataatccctgttctgtttcactgatggtgtttgcagcaccactgttcatggtggtccactgttatcctatgccagggtgctaagaattgcatgatattcatcttccctgctctatttaaatttacatctataagagtcatcttgacattaacactgaaatgtgatctaggtccttaaccaaaattgctgggcaacttgtaataaatttagacagaaattttatgagtaccacaaagcttggtgttaccacatcaccagaaggatttcttaggaaatgtcttgccgagagagctggctctctgcatatagatgtctttgtcagaaaaccaacccttgctctcacttacacagtagtaagcactgaaagtggttcagttcatgagaggacagagaattattttgagattatatttgaatgtaatcttgcagagccaaatatggtatgtcattaagttggaaccttgtaaatagctgttccatgttataaaatgagaaactttgtaactggaaaaaaaaaaa

SEQ ID NO: 428523 - DNA, 672 bp, Homo sapiens
atctgcagaggagcacaaggagtgaactgcttttcattatggccagtgctctgtattagagctctgacagtatctccagaatacagtaggagcctgggcatctgttgatgtttttcccagtgttctaggttaatgttttatttggttgcctgcataatccctgttctgtttcactgatggtgtttgcagcaccactgttcatggtggtccactgttatcctatgccagggtgctaagaattgcatgatattcatcttccctgctctatttaaatttacatctataagagtcatcttgacattaacactgaaatgtgatctaggtccttaaccaaaattgctgggcaacttgtaataaatttagacagaaattttatgagtaccacaaagcttggtgttaccacatcaccagaaggatttcttaggaaatgtcttgccgagagagctggctctctgcatatagatgtctttgtcagaaaaccaacccttgctctcacttacacagtagtaagcactgaaagtggttcagttcatgagaggacagagaattattttgagattatatttgaatgtaatcttgcagagccaaatatggtatgtcattaagttggaaccttgtaaatagctgttccatgttataaaatgagaaactttgtaactggaaaaaaaaaaa

SEQ ID NO: 428524 - DNA, 719 bp, Homo sapiens
tatagattgagctttaccctgtgtcccatgcacagttggacgtgttgtggcctagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggtgagcactgtacacccagcaccagccacacagcaggcgacacatggaggtccacggtctctgccctccctgggaccagggctatggttggggaagcacagggactgtggcaaaagggaagaggcctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaaggcctgtggggctgcgtggagcccggtactggaggccgacgggggtgacggggacgctgagggcacagagcggaggggcatgatggctgctgggcgtggaggtgtcgagagtaactgtgcatgggaccggctccatcgttgt

SEQ ID NO: 428525 - DNA, 383 bp, Homo sapiens
  misc_feature (375)..(375): n is a, c, g, or t
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgagaccttgcctgcccggggnggattcct

SEQ ID NO: 428526 - DNA, 355 bp, Homo sapiens
gtccatgagccttcccggcaaaacgcccaataagggagaaggggcaggcgcggcgggggccggggttccctgaagtccccttcgtttccagaatccctaaagatcattccgccccccagggaggaaacccaagctccgccgagcgcggcgggtctgtgccttcgcttcgcttccagcctctcgcttccttctgacccgaccccgagttctttctccggacggtgtcgagaacccgggcgccggctggggctggagtctcgctggcctcggagcgcccccgagccctcgggcgacagcgaggcgaggacccagggaacgtcaggcctctgcatgtgacccacgcggcctccccctt

SEQ ID NO: 428527 - DNA, 309 bp, Homo sapiens
cacgctgaggcctgagcctgcctctctgccttctcagcagagcggccggccgctgtgaccactgctctcaggagagtgggggatgagaggccagaggtgatgcaggctcaggcctcagcgtggacagcagggataaggggcacgaaggacggggactcggccccttcagaattccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428528 - DNA, 2715 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggaagttccagctccgagttccctgggaggactttttcagatgttagggacccgctccagagccccctctgggtcaccctgggttcctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428529 - DNA, 3572 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428530 - DNA, 2473 bp, Homo sapiens
tggggagggcctgcagatctgagtgggcagccgaggaggaacccagaagacgccagcgatggagctctgccggggcggaatgtggccaggaggggcgggagcagtgacggcctgtccggcgctagaacgagggaccgtgctctcaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428531 - DNA, 3739 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggtgagtggaccccttcaagggctcctcccctgccgtcgagaccctcgagtctgtcctggaacaccttccagtcagcggcacctccctgtaggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428532 - DNA, 3483 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428533 - DNA, 3668 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctgtcagcggcacctccctgtaggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428534 - DNA, 3380 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428535 - DNA, 3429 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428536 - DNA, 1946 bp, Homo sapiens
ggaaagctccagaagcagcaaggaagccaggcataagttgggagcgactgagccactccaggaggaggtgtgggcccacggcgtgttggaggtggagccacaggacctgtccataggttggatgctgtgtgggtgacagagagaaaccggggctcacggcctgggcagcgggacgggcggagtcgtcctcacctgtgctggggaccctgtgggagcagcaggcttccgagcacgtgctggaccccggcgtctccggctgcaccgagtggtcaggacattgaggccgggtcagggagcgtgagataccgggacgagcggggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagccccaggctgcctctctccctgcaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428537 - DNA, 1127 bp, Homo sapiens
tcaatcccaggctcctcttgactctgggcagctttaatcaggttgggcagcttctgctacagcgtggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcatta

SEQ ID NO: 428538 - DNA, 4000 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcaggcgctgtgaacttcctgacaggcatggggggcttcctgcaggcggtggtcttcgggtgcacggggttcagggtcacccgagcgggtgtgacctttgaccctgtgtgtctgtcggggatctccagagtgagcgtctccggcatcttctaccaggggaacaagctcaacttctctttttccgaggactccgtgaccgtggaggtcacagctcgagcagggccctgggctcctcacctggaggctgagctgtggccatcccagtcccggctctccctgttgccaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccctgtggactgatgctatcgcgcaccgtcccacgaccccaccccgagctcctgaagccggggtctgagcctgcatcacctctggcctctcatcccccactctcctgagagcagtggtcacagcggccggccgctctgctgagaaggcagagaggcaggctcaggcctcagcgtggacagcagggataaggggcacgaaggacggggactcggccccttcagaattcctcaggactctcaggtgcagctttgccaaaaaggaacttttcatgtcatgcagttgaggggacttagtctcaatcccaggctcctcttgactctgggcagctttaatcaggttgggcagcctctgctacagcgtggagtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggccccctgcaccgctgtcagcctgaggaattaaagctttggtgctgggaagagcattattcctctgaggagccgctgtgcttccttctgaagtgagggccgtgccccgggtcccatttctcctttcacttgagtcgggaagcacagcaactttaaggctcgcgcccagcaacatggctcccctcgcatctgcatctccctcctgctctggtgttgccgctgcaccctgtcctcggaggacagcagaggtttggacggagactcagggagggagggaaggaggcaaggacgcctgtggaaacatctttcaggcagctctagggtctgggggccaggatgcctgggtctcccaaggcctgtctgctgtctctgccaccctcagcggctgccagaagcagcgtgtgggggaggcatgtgctgcagcacacctgcggccgagaccagcactcagaggtcggctcccctgacaggaaccgtgtagggtgca

SEQ ID NO: 428539 - DNA, 1756 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggtgagcactgtacacccagcaccagccacacagcaggcgacacatggaggtccacggtctctgccctccctgggaccagggctatggttggggaagcacagggactgtggcaaaagggaagaggcctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttggagtttacctgagggccagtggagctccagggacctatcaggacggggacctgtggggactgggaaggcctgtggggctgcgtggagcccggtactggaggccgacgggggtgacggggacgctgagggcacagagcggaggggcatgatggctgctgggcgtggaggtgtcgagagtaactgtgcatgggaccggctccatcgttgt

SEQ ID NO: 428540 - DNA, 1976 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggagtcatgtcccccgacgagtaccactcaggggtcaacaactctgtgtacaccaacgtcctggtccagaacagcctgcgctttgctgctgccctggcccaggacctgggtcttcccatccccagccagtggctggcggtggctgacaagatcaaggtaccctttgacgtggagcagaacttccacccggagttcgatgggtatgagcctggagaggtggtgaagcaggcagacgtcgtgctcctgggatacccagtccccttctccctgagtcctgatgttcgcaggaaaaatctggagatttacgaggctgtgacgtccccccagggccccgccatgacctgggtgagcaccctggggctgtggag

SEQ ID NO: 428541 - DNA, 733 bp, Homo sapiens
ggaaagctccagaagcagcaaggaagccaggcataagttgggagcgactgagccactccaggaggaggtgtgggcccacggcgtgttggaggtggagccacaggacctgtccataggttggatgctgtgtgggtgacagagagaaaccggggctcacggcctgggcagcgggacgggcggagtcgtcctcacctgtgctggggaccctgtgggagcagcaggcttccgagcacgtgctggaccccggcgtctccggctgcaccgagtggtcaggacattgaggccgggtcagggagcgtgagataccgggacgagcgggcccagggctgagcccagcggcgtccgggtgggcggtggcgttgagatgggaattgggaattgcaccggtggtctcaggaggatggaaaacccaagcagcagctgcaccaggaccgaggcaaagggaccgcagtttaacagaaaacccaaaacgagagcgagaaaacggccaaacacccgtgcgaggaggaaacccaagctccgccgagcgcggcgggtctgtgccttcgcttcgcttccagcctctcgcttccttctgacccgaccccgagttctttctccggacggtgtcgagaacccgggcgccggctggggctggagtctcgctggcctcggagcgcccccgagccctcgggcgacagcgaggcgaggacccagggaacgccaggcccccggacgcgacccacgcggccgc

SEQ ID NO: 428542 - DNA, 1877 bp, Homo sapiens
acagagggtgggggcaagaccggggttgtggggggtgcgtttggaaagcagggttaggactggaattctaaggtagcaggagggagagacacactcaggggctcagctgggttcctggagatcaacctttggggtctgagcccctctgagagtcgagctcctttcctgcgaggccccgtctaggaggggcctcaggaaaatcggggctgcccagctggttccgcaactccccccagttctgagggaggcttcaggggattacagacggtctcaagagggaggcccagccagtcccgcggcccctgacaccccatcaggccgctcaggcccagcagctccatggaggacgccggcgaggaccccaccacgtttgctgcccactctctgcccagtgacccccgtctcttggccactgtgaccaacgcatacctgggcacacgagtgtttcacgacacgctgcacgtgagcggcgtgtacaatggggctggcggggacacgcaccgggccatgctgcccagccccctcaacgtccggctggaggcccctgcagggatgggggagcagctgaccgagaccttcgccctggacaccaacacaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggacctctggatgttcccgagtatcctgatgttccacccagaagccgccagggccatcctggagtaccgcatccgcacgctggacggggccctggagaacgcccagaacctgggctaccagggagccaagtttgcctgggagagtgcagactccggcctagaggtttgccctgaggacatttacggagtccaggaggtccacgtcaacggggccgtggtgttggccttcgagctgtactaccataccacccaggacctgcagctatttcgagaggctggtggctgggacgtggtcagggctgtggccgagttttggtgcagtcgtgttgagtggagccccagggaggaaaagtaccacctgaggggtgaggccatggtggggaggggctcggggaggaatggtggatgctcccagactcagcagatgattttcagacacctcacgtgtgccagccccacgctgaccaccggcgtggagggaaggcctctgagactctgcactgagcaccatcttggacttgtgtgtccaggagtcatgtcccccgacgagtaccactcaggggtcaacaactctgtgtacaccaacgtcctggtccagaacaggtcagacacaagatcccctcacctcacccc

SEQ ID NO: 428543 - DNA, 465 bp, Homo sapiens
ggaaagctccagaagcagcaaggaagccaggcataagttgggagcgactgagccactccaggaggaggtgtgggcccacggcgtgttggaggtggagccacaggacctgtccataggttggatgctgtgaggatggaaaacccaagcagcagctgcaccaggaccgaggcaaagggaccgcagtttaacagaaaacccaaaacgagagcgagaaaacggccaaacacccgtgcgaggaggaaacccaagctccgccgagcgcggcgggtctgtgccttcgcttcgcttccagcctctcgcttccttctgacccgaccccgagttctttctccggacggtgtcgagaacccgggcgccggctggggctggagtctcgctggcctcggagcgcccccgagccctcgggcgacagcgaggcgaggacccagggaacgccaggcccccggacgcgacccacgcggccgc

SEQ ID NO: 428544 - DNA, 600 bp, Homo sapiens
ccgtgaccgtggaggtcacagctcgagcagggccctgggctcctcacctggaggctgagctgtggccatcccagtcccggctctccctgttgccaggtagaacagcccccaacagcccaggtgcctgcgaccccaggctgcccctcacccccaggctgcctctctccctgcaggacacaaggtctcctttccccgctcggctggccggatacaaatgtcacccccgaagctgcctggaagttccagctccgagttccctgggaggactttttcagatgttagggacccgctccagagccccctctgggtcaccctgggttcctccagccccaccgagtcactcactgtggaccctgcctctgaataatcaggaacggtggcttcagagacgtctcttgggccttccctctggccacgtctgcacccacccctcctgggcaccctcctagcctgccatccctcacctgcagccaggctctcagggaaggtccatgctgcttggcctgagttcaaggctttctgcctgtagcctggactcccgtggacccccgtgggcaggtggcttccccgtggcatctccacaccgcctctgcctgcccc

SEQ ID NO: 428545 - DNA, 735 bp, Homo sapiens
cgagtggtcaggacattgaggccgggtcagggagcgtgagataccgggacgagcgggcccagggctgagcccagcggcgtccgggtgggcggtggcgttgagatgggaattgggaattgcaccggtggtctcaggaggatggaaaacccaagcagcagctgcaccaggaccgaggcaaagggaccgcagtttaacagaaaacccaaaacgagagcgagaaaacggccaaacacccgtgcgagtgagacgtccatgagccttcccggcaaaacgcccaataagggagaaggggcaggcgcggcgggggccggggttccctgaagtccccttcgtttccagaatccctaaagatcattccgccccccagggaggaaacccaagctccgccgagcgcggcgggtctgtgccttcgcttcgcttccagcctctcgcttccttctgacccgaccccgagttctttctccggacggtgtcgagaacccgggcgccggctggggctggagtctcgctggcctcggagcgcccccgagccctcgggcgacagcgaggcgaggacccaggtggaggcggccgggggcgcgggcggagggaggaggcgcgggagggaacccccggcccgcgggccccacccacagccgccccgggacgcagctcggggtccaggctcgagctttgctcactcagggcgcttcgtgcagggaacgccaggcccccggacgcgacccacgcggccgc

SEQ ID NO: 428546 - DNA, 336 bp, Homo sapiens
gctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtaaggagggggctggatttgcagccagggagtccagggagggagctcatccctgaggcatggccacgctctcacaggtacctgtatggccacaccctcacccctgagcagcccggggggccaca

SEQ ID NO: 428547 - DNA, 347 bp, Homo sapiens
tgtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaacgtgagtgtggggagggctctc

SEQ ID NO: 428548 - DNA, 472 bp, Homo sapiens
tcagttcttaccaaatcataggcacctgctctaggccagggtccatgggccctgagataccatggaaatgcaaaggcaagtctccgccttcatgcagcataggatctggctgatgagaccatcactttggccacaccactgttcaccccacatgaaagagcaccctggggaaagccagggtctgtgtctccttcattctctgccccatgcctggtgcaaggtctgaggcagagacggactatggacagcaggtagtttgctccacgtgttttcattaattcctgtgctcagtagggaaactgacatgagcatggtgcttgaatccatcacatttcatactaatgctacattttcttccagtcattgccatctggacacatacaaggaacttttgaactggcaaataaagaagaaaacagagaaaaaaacagatatcccaacatccttcccagtaagattttattttatgttt

SEQ ID NO: 428549 - DNA, 5335 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428550 - DNA, 4879 bp, Homo sapiens
tgtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428551 - DNA, 4908 bp, Homo sapiens
tgggcccagtgcagggttcataaaatacagcccttgcactgccaggggcctggcacattctgctattcttgctatgtaatgacccagcagcccccatcctggatgctgaaatcctacccttgtcgtcatgccacagctgagacagtcagtgttcaccaaagcaggtgcattctctctcaggacactagtgttctccatgggaacgctgaggaagaacatctctgccatccctggtgtcgctgtgaagctgcttttgcccttcccaggagctgacactgcagatgaagagacagcactgtgatttctggaagagacagcactgtgattcctggtcctaatatcttggctttgtttgggttttttttccagatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428552 - DNA, 4535 bp, Homo sapiens
agaagggagtgaacagctgtccaggggccaacggccagggtgccggggctgggaccccaaagggacttcccttcatgccttttgacttcgaaattgtcctctacacacaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428553 - DNA, 5036 bp, Homo sapiens
tgtgcagcagagggcagctgagaggctgggtggctgggcctgggagacacacagaggccaggccttagcgcggctcagccatgagcaacaggagtagcttttcccggctcacctggtgggtatcactgtgccgagcgctgttggctctcggggaacctagaagtgtggaaacctaacgcatcctgtgtctctaaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428554 - DNA, 5389 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactaccagcctgtgtttttgtctttaaatctcttaatttcattcctctgcaaaaaaaaaaa

SEQ ID NO: 428555 - DNA, 2618 bp, Homo sapiens
tctcagttcctactggagagccttcaaggaaaagtgccatcagtactggcccgaccaaggctgctggacctatggaaacatccgggtgtgcgtggaggactgcgtggttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428556 - DNA, 2641 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaattttt

SEQ ID NO: 428557 - DNA, 1866 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatgtgagtcatgccttcctcttgccctgatctagcttcccaaagcaaacccgatgccttcgccacacaggtgtgcagggccctggctctgatgggcacgtggcaaccagcctgggcctggcctggcttcgctccccatagccttccctgcccacgcgtgggacctcagggactccctcgtcctcatctttccctcgtatcctcatgtgagatggggcaatcctactcccccaaacggtgcatgtacacagtgcgtggcgtgctcaccaatgtgaggctctgctgctaccgttctccttactcaagggcataaatggtcgttatccgtggccggtactctgactcttgcctcacacctccttgtgttggcaaaaagagaaaaagaagaaagccgccctctttggtctgccaagctccacgtgggccaagactgcagggcag

SEQ ID NO: 428558 - DNA, 912 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatctacaaagagaagaataattcatagcagcaccacctgcg

SEQ ID NO: 428559 - DNA, 115 bp, Homo sapiens
ggggaatacaaactctgtttaagtaatgattttgaaaaaaatctctctgcaccagtgaatgccatgaacagtttcattttcagtaagcgcttgcagccagttgtctagttgtcag

SEQ ID NO: 428560 - DNA, 679 bp, Homo sapiens
gtttcaatgtgaaagccacagacatttaactcagcccattaaatacactaagttgaaatgttaatacactaactgacacattctacgtagaaaaacagctttatttggaattctgcatgtgcctaaaaactaaattacgatgtgcataaaggtatatggtattttaatgaatagtcacacttatttatgtcttgtttttgagtatttctcctgattaatcaaatatatttttgggaatatcattttaatgtgtccttgtttgtcttttcaggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgca

SEQ ID NO: 428561 - DNA, 2262 bp, Homo sapiens
tgtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaattttt

SEQ ID NO: 428562 - DNA, 4956 bp, Homo sapiens
tgtgcagcagagggcagctgagaggctgggtggctgggcctgggagacacacagaggccaggccttagcgcggctcagccatgagcaacaggagtagcttttcccggctcacctggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428563 - DNA, 5511 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagtaagcgcttgcagccagttgtctagttgtcagaagccgagctcatcagcgggctcctggtgtcggcgttctgctgctggaaggtcagggagttccctggaccccacggaagaagctgtctccatgaaggacagggaccgtgccgtgaaccttttattctcccactgacatgctctgagcctgtccctgcctctctgcaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428564 - DNA, 5157 bp, Homo sapiens
gcctccctaaagggaatttgcccctcaggccaaagaattcggcacaatggattctccaaggccaggatggtttcccagcgtcttcccaggaagacaagaggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428565 - DNA, 4990 bp, Homo sapiens
tcagttcttaccaaatcataggcacctgctctaggccagggtccatgggccctgagataccatggaaatgcaaaggcaagtctccgccttcatgcagcataggatctggctgatgagaccatcactttggccacaccactgttcaccccacatgaaagagcaccctggggaaagccagggtctgtgtctccttcattctctgccccatgcctggtgcaaggtctgaggcagagacggactatggacagcaggtagtttgctccacgtgttttcattaattcctgtgctcagtagggaaactgacatgagcatggtgcttgaatccatcacatttcatactaatgctacattttcttccagtcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428566 - DNA, 5281 bp, Homo sapiens
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactacca

SEQ ID NO: 428567 - DNA, 3131 bp, Homo sapiens
  misc_feature (3021)..(3021): n is a, c, g, or t
  misc_feature (3051)..(3051): n is a, c, g, or t
  misc_feature (3071)..(3071): n is a, c, g, or t
  misc_feature (3088)..(3088): n is a, c, g, or t
  misc_feature (3123)..(3123): n is a, c, g, or t
  misc_feature (3131)..(3131): n is a, c, g, or t
agccacagccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcggaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaaanaacggttgtctacccctaatctttgggtgnaaccaaaaaaaaaaattttnaatgcctgggggtggtnccccgttgaaacccccgggggtttggggtttcaanaaaaaccn

SEQ ID NO: 428568 - DNA, 265 bp, Homo sapiens
tacttcgggaggagtgtgactcacgacgcagcatctttctctttccccaaagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatgtgagtcatgccttcctcttgccctgatctagcttcccaaagcaaacccgatgccttcgccacacaggtgtgcaggg

SEQ ID NO: 428569 - DNA, 6763 bp, Homo sapiens
  misc_feature (4398)..(4398): n is a, c, g, or t
gctagccttgcgcggcgcgggagagcgcagtggcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacagtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttgggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagnggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaa

SEQ ID NO: 428570 - DNA, 6420 bp, Homo sapiens
  misc_feature (4055)..(4055): n is a, c, g, or t
gctagccttgcgcggcgcgggagagcgcagtggcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacattgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttgggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagnggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaa

SEQ ID NO: 428571 - DNA, 6814 bp, Homo sapiens
  misc_feature (4398)..(4398): n is a, c, g, or t
gctagccttgcgcggcgcgggagagcgcagtggcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacagtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttgggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagnggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaa

SEQ ID NO: 428572 - DNA, 2306 bp, Homo sapiens
tgaattattggtcctgtggtatgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaa

SEQ ID NO: 428573 - DNA, 295 bp, Homo sapiens
ctgcatgtggatgaagctctagaacatttgatgagagttttagagaagaagactgaaggtaggactgtggtaatcacaagttttcaatagaatatatgtctttgcttatattggtatagcttgcaaattcaggagagtctgaatatgcaggctgagaatatctgtgtaacatctgtaaatgtttatgttattcattcttcaagagaaccttcttgggaaaggatcctcattggtatgatgattaacattttcttcatttgtattcctgtgctgtatttattaacgggagggcatg

SEQ ID NO: 428574 - DNA, 316 bp, Homo sapiens
attgatttgagagcttaccatgtttgggaaattgcaggatctatggaggaaggccataacctggccttcaccactgaggagcttacagttgagcagtcagcggctccatccttggggaggtgagagagcgtaacattcacttgcttgattgttagtgtaagaggagccagcaaaggaggaaagagttttctctttcggagttgtcatcacctagggcaatcgtttctgatcagtcaaaggcccacacaggtttgagtcccagctgcagatgcaactcatggctgtgttagtgattctgtagcagctgatgaatgca

SEQ ID NO: 428575 - DNA, 953 bp, Homo sapiens
ggtaccggtcccgagttctttggatgcagctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcacttaaaaaaaaaaaaaaaaaaaaaaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgttt

SEQ ID NO: 428576 - DNA, 728 bp, Homo sapiens
cccacgcgtcgcggacgcgtgggtcgacccacgcgtccgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaaaaaaaaaaaaagggggggccgcaaagattcc

SEQ ID NO: 428577 - DNA, 680 bp, Homo sapiens
aaaagatgaacaatggttaattctgtggagtgggagcatggtgggtgattattttgtttatgcttttaggtatgtttccaaccatcaaaccaaaaaaaaaagaaaaagagaaacagatccttgatcttaacaggaaatggctgtcattatgagtattatttctattccctgttttcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcacttaaaaaaaaaaaaaaaaaaaaaaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgttt

SEQ ID NO: 428578 - DNA, 248 bp, Homo sapiens
acaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgtttaaataaacttcttgtttaaaatgaaat

SEQ ID NO: 428579 - DNA, 1596 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428580 - DNA, 1466 bp, Homo sapiens
tgatggcagtaatctcggggtataaggtacgaggctgggtctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428581 - DNA, 1470 bp, Homo sapiens
gagctcaaggatccttaattaaattaattccccccccccccgagctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428582 - DNA, 1455 bp, Homo sapiens
ggtaccggtcccgagttctttggatgcagctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428583 - DNA, 1627 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaaaaaaaaaaaaagggggggccgcaaagattcc

SEQ ID NO: 428584 - DNA, 1586 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgtctctccgcagagccttcttggtgttgccctaaccttgccagtggcctttgctcagagcctcctcctgtgacatgagaacaatgaagaggcctgcgcctcctgccttgccgcctgcaaagcaa

SEQ ID NO: 428585 - DNA, 1520 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacaactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428586 - DNA, 1691 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagacacggggtcttgccatgttgcccaggctggtcttgaactcctaggctcaagtgatgatcctgccttggcctcctagggtgctgggattacagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428587 - DNA, 2607 bp, Homo sapiens
agccccgtgcgctgtgctcgcgccggggcgggtggcggggttctgccgtcggcgccgcctttgtgccgcctggcgagccctgcgcgccggccccacccgggtccctgctgctctccattcattccttccacggagtcaggggctgaggaggccggggctggtcgcccctcggagcacggccggttttcgttaatcggaaccttcggggagggcttcgctttctcctgtgtgcatcccggctggtgcatccccagggtggtgggcttggccccccaggtgcccggggatcctttagggccccatgcatggtcaggtcctattgtcccattgatgggccacgcgctcctgtctctcccccgtggcatgcggttggtctcgctctcgcgcgcagccattggatccggagaccggatcgatcaggtccggcgggctccttaccctcgccgtgcccccactccttattcggacctacctgacaggtgcatgtgtggtcgagcggggctggtcatcgcgacccttcaccccccattgaggacccaatcgttcttcccctcttcgaagtgcctcccctcttccaagtgtctccccttcctaacaaaggaaagaccccttctccccatccctgcgctcatttctaaggcggggggcgggggcgggcgcggggaacgagccaacccgagtgggttttctgcgcttaaaccttcggaccgtggcctttgcatcctaccttcgcttcctcctttgacgtttgcccagtgagttcatccctggccctggttcccttgcaggaggaggtttcttgttcttgggcggggccggagacatccattgtctctaacgtggtagcgctacctgggaagcgggggatttttcttgcccttcttcccactgctttttgggcttggggcactgggtacagtgtttggacaggaacccttttccaagtccttgcttaacttacttggtggaagggtttggattctgtggaaggtgtccacattgtctcagctaattgcacactgttctttaaggtgggttacagttatgtctgggatcctcttcaaggcttggaagaagcttaaatcacttttttgagcatgtattttacatcgattatgacctgcattcatgtgtggctaccctcggggtcctggccaagtggcacaaagggagccattttgtggggctaagaagacacgtgaaatagccatatctcacaggggttagagaacttgggaacaaaaagcacgcctcactcagcaattgagccttaggaggaaagcatgggaaatgacattcctttacaactcaatactttcaggtttacaaggtcaaaaagactagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428588 - DNA, 1683 bp, Homo sapiens
agccccgtgcgctgtgctcgcgccggggcgggtggcggggttctgccgtcggcgccgcctttgtgccgcctggcgagccctgcgcgccggccccacccgggtccctgctgctctccattcattccttccacggagtcaggggctgaggaggccggggctggtcgcccctcggagcacggccggttttcgttaatcggaaccttcggggagggcttcgctttctcctgtgtgcatcccggctggtgcatccccagggtggtgggcttggccccccaggtgcccggggatcctttagggccccatgcatggtcaggtcctattgtcccattgatgggccacgcgctcctgtctctcccccgtggcatgcggttggtctcgctctcgcgcgcagccattggatccggagaccggatcgatcagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428589 - DNA, 1742 bp, Homo sapiens
agccccgtgcgctgtgctcgcgccggggcgggtggcggggttctgccgtcggcgccgcctttgtgccgcctggcgagccctgcgcgccggccccacccgggtccctgctgctctccattcattccttccacggagtcaggggctgaggaggccggggctggtcgcccctcggagcacggccggttttcgttaatcggaaccttcggggagggcttcgctttctcctgtgtgcatcccggctggtgcatccccagggtggtgggcttggccccccaggtgcccggggatcctttagggccccatgcatggtcaggtcctattgtcccattgatgggccacgcgctcctgtctctcccccgtggcatgcggttggtctcgctctcgcgcgcagccattggatccggagaccggatcgatcaggtccggcgggctccttaccctcgccgtgcccccactccttattcggacctacctgacagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428590 - DNA, 1625 bp, Homo sapiens
taaacttctttgaaagtatattcagccaagcccagtagagtaaggtccattagatcttttgccatttctgaaaaggggacaccaaccaggctgttatttatgatgagttccatgctgtttcagctgccttgtgtgatcgatgaccttattacaagtattataaagcagtatttagtatcttaacatccagcactgaatgtagacactgatggagttgattcttttttcctgttagcagctatctgttgtaggggtgagggagatgaatgggtgaggaaagtgaaatgaaagttgtctgaaaagatttatgccaagaaatgtttcagtatgatctgaagttgatgttttgccattatttgcagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428591 - DNA, 1311 bp, Homo sapiens
ctcaattagaaaactgcaatttggttccaccacatcctgactactaccagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428592 - DNA, 1307 bp, Homo sapiens
gtctccccgccagtctgtgctaccatcagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428593 - DNA, 1094 bp, Homo sapiens
aggctgagccgtggccgccacagcccatcgtaatgccgcatggtgcttggcactccagagagccaataggaatgaaagaattcatttgaatcggccaatgccggcgggttagggggcgggggttgaaaaccctataaaggcgtcgatcggccggacaggcggagcggcggctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcacttaaaaaaaaaaaaaaaaaaaaaaaaaaaaaaaaacaacaacataaaaatccttgcataccttgttcaattggagaattttaatgtttttcatttatcattgtaaaaccaaggacaattttataacttttttgtacgtagctgttacatgtagggcaatctgtctttaagtagggataaattactctaaaacaaaaaagaatcctagatagttttcccttcaagtcaagcgtcttgttgttt

SEQ ID NO: 428594 - DNA, 1160 bp, Homo sapiens
gagctcaaggatccttaattaaattaattccccccccccccgagctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagcccggtggccccggccccagtgccatccagaagaaatccccctggcggcaagtccagcctcgtcttgggttagctcactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428595 - DNA, 1400 bp, Homo sapiens
tgatggcagtaatctcggggtataaggtacgaggctgggtctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatagagaaggtgatattcatgaaaatgtggacacagacttgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428596 - DNA, 1308 bp, Homo sapiens
tgatggcagtaatctcggggtataaggtacgaggctgggtctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatatgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428597 - DNA, 998 bp, Homo sapiens
gggaatacgacttgacccgacagacagaggcgtggggacaactgggtctgtagggcgacgcttttatccgagacagatccggcccctcctgtgccatccagaagaaatccccctggcggcaagtccagcctcgtcttgggttagctctgactgtcctgaacgctgtcgttctgtctgtttcctccatgcttgtgaactgcacaacttgagcctgactgtacatctcttggatttgtttcattaaaaagaagcactttatgtactgctgtcttttttttttttcttttgaagaacaggtttctctctgtccttgactcttgggtctgtgggccatggcatgagtgttttctagtagtagattggagggaaagctttgtgacacttagtactgtgtttttaagaagaaataatttggttccagatgtgttagaggatcttttgtactgaggtttttaacactttacttgggtttaccaagcctcaactggacagaccataaacagtccacaggcaccgttcctgccaggccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgttgttttaaataacctgatgctgtgtgcatgatgctggtgcttgaccatgaaaggaaagtctcatccttaaaatgtgttgtacttcacaatcctggactgttgcttcaagtaaacaatatccacattttgaaa

SEQ ID NO: 428598 - DNA, 1004 bp, Homo sapiens
gagctcaaggatccttaattaaattaattccccccccccccgagctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatattcatgaaaatgtggacacagacttgccaggcagcctggggcagagtgaagagaagcccgtgcctgctgcgcctgtgcccagccccaacccacagggagtctctccgcagagccttcttggtgttgccctaacttgccagtggcctttgctcagagcctcctcctgtgacatgtgaacaatgaagaggcctgcgcctcctgccttgccgcctgcaaagcaaagaaactgccttttattttttaaccttaaaaagtagccagatagtaacaagactggctggctgatgagcaaagcctttgctctcacgcagaggaaggcttggatgtacaatgaaactgcctggaactaaaagcagtgaagcaagggaggcaatcacactgaagcgggtcttcctccaggaacggggtcccacaggcgtgtctctccgcagagccttcttggtgttgccctaaccttgccagtggcctttgctcagagcctcctcctgtgacatgagaacaatgaagaggcctgcgcctcctgccttgccgcctgcaaagcaa

SEQ ID NO: 428599 - DNA, 1112 bp, Homo sapiens
tgatggcagtaatctcggggtataaggtacgaggctgggtctcctgcagcggtggtcggctgttgggtgtggagtttcccagcgcccctcgggtccgaccctttgagcgttctgctccggcgccagcctacctcgctcctcggcgccatgaccacaaccaccaccttcaagggagtcgaccccaacagcaggaatagctcccgagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtgccaagtctagtggtggcagggaagacttggagtcatctggactgcagagaaggaactcctctgaagcaagctccggagacttcttagatctgaagggagaaggtgatacagcatgaggccagaaaggctttcaggtcaatatgattctgaaatttgtactaagagtttcagttcacccactggaattttacattgaggtagttaggaaagggactgggccatattgataatggaagattgatagtaaaatcatagaagtgtgttaacatggtctcagtctgtttctgtatctcttttaccattaggatttgttttatctcccctattgatttttggaacttgtggatctttctcacttcctgtgtgtctcatatatagaagcatttctgagttcagaactgctttgcgttgaactccaggagactagtgctggcattaccattggttgtgtctgcagttgaatactgccaccaagccccccagggggtgtgctgcgaagtggaaagaccccgcccgactaagcactaaagccctcagagcacagtgaggcatcacctgtctgagtggggagagaactggagaagggctttggaactgataggggtccttccataactattatctagtttccccttatcggggaaaggagagagaaatgaaaggagagatttaccagttttccattctaataaaagatctctgaagtgctaattggtgttaggtcctcagaggaaatgttggggtttgttgtagacgtggtact

SEQ ID NO: 428600 - DNA, 349 bp, Homo sapiens
gagatgaatgggtgaggaaagtgaaatgaaagttgtctgaaaagatttatgccaagaaatgtttcagtatgatctgaagttgatgttttgccattatttgcagagttttgcggcctccaggtggtggatccaatttttcattaggttttgatgaaccaacagaacaacctgtgaggaagaacaaaatggcctctaatatctttgggacacctgaagaaaatcaagcttcttgggccaagtcagcaggtactcttgttatctgtgctcactgttcaaagggatgggcccagcatcaacagccacagatgcagcttgggcaccagcatgtgcccccgtgtctaaaaaacaa

SEQ ID NO: 428601 - DNA, 1133 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgt

SEQ ID NO: 428602 - DNA, 1034 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgt

SEQ ID NO: 428603 - DNA, 615 bp, Homo sapiens
attctgcaacctgccaaattctgtggtctctgctggcgcctgtcctccactatagccatctgccctttgcctccctgtttacttctctggatgccctttccctgagctcacacaccccttgctctaggaggcagtagcaagagatttggatgcagtagttctctctccggggcactaaccactctgcttctctccagagagctaaacaaaagggcgtgatccacatccgagttgtggtgaaaggcctggggccaggacgcttggtaagttacagtgatttccatagtgtacttgcctcctagtaagtgtgagaatttggggcttgagagcagagtacagggagagtagtataattgaccaagcccctcagagcaagcctagatcacttagtataattcatcagacactgagtgcctgctgcgtgccacgcactgggaatgggaaggtggttcctgggggaactgtcacaaacaaatcccttaggacagactggtgagcgctgtggtaaagcatgtgcccagatcgctgggagcccatcaggggatcccgaacctagcagggataatctttcctgatgatcattagcacagataatctttagcttcttcaaagagg

SEQ ID NO: 428604 - DNA, 146 bp, Homo sapiens
tctttgttcgcagatcgtaaagtgcaaagtggaaagtggtgggtacagtttgagaggggaacagtgtgaaaacctggttaaagggtttgggtggagaccttttgggctacacattatggaggtgtatcctctagagtcagctctga

SEQ ID NO: 428605 - DNA, 1146 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgtgcccgcctcgaagtggatcctcatagagtcagccttga

SEQ ID NO: 428606 - DNA, 2382 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcaggtgagccccacttggaccagccctctggagacccgcaacccctgactcttgcccgacaccctccagagtcagaaccagtgaattttcagctatgtcacttgctatccgtgggaccttatgcaaataaatctgagcctcagccttctcatctaaaaatgcggataatgctgagagaggttgtgagaatcagatgagccgtggtacagagtaaatgttcagtgaacattcgttaaatcaatgagtgaatgtgagatatccataacatgtatcagcgttcttttcttctgagatggagatcttttcagaccaataaccttccctgcctccaaaacaaaatggggaggtagagggcgctagcgatggaacagatgttcctgcacgtcttacggatggtccagggtgggttttgtgctcagccctaggaactggcatcttgcttcccaccagtgccaccacctctgtatgctgtatacacatccacttaacttcacatccatttaacaaacatttaccaagaatctactatgagtgagacaccatgctaggtgccgtgaatacagatacaaaagatcattcctccccacaagtagttcacagtctttgagggaagacaaacatgcaaacattttaaccataatctgctcaataatataatggaggtaagcattggttggaagtatgaaatcataagtgtctaactcctggccgggtgcagtagctcatgcctttaatcccagcactttaggcggccaaggtgggcgaattacttgaggtcaggagatcgagaccagcctggccaacatggcgaaaccccgtctccactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagaaaaaaaaaaaaaaaagaataagtgtctcattcctgaggaaatcaggcaagaccatggagaaaagaacatggagctcagaagtgaatgggagttcatctggacaagttgaagtgggtcattggagacaaagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428607 - DNA, 2507 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccgggtaacaaatgactgccccctcgagcccaccgccacctccaggactatgctcctactcgtgtcccttgagccacccgggccccagtgaccgttaggccgtggccctcaccgagcttttcttcccagcagggtcgtggccagaacgccggccgggaccatctgcacaggcgctcgacagctccaagacgctgcggccaagcagaaagttgaacagaacgcggctcccagccacaccaagttcaggtgagccccacttggaccagccctctggagacccgcaacccctgactcttgcccgacaccctccagagtcagaaccagtgaattttcagctatgtcacttgctatccgtgggaccttatgcaaataaatctgagcctcagccttctcatctaaaaatgcggataatgctgagagaggttgtgagaatcagatgagccgtggtacagagtaaatgttcagtgaacattcgttaaatcaatgagtgaatgtgagatatccataacatgtatcagcgttcttttcttctgagatggagatcttttcagaccaataaccttccctgcctccaaaacaaaatggggaggtagagggcgctagcgatggaacagatgttcctgcacgtcttacggatggtccagggtgggttttgtgctcagccctaggaactggcatcttgcttcccaccagtgccaccacctctgtatgctgtatacacatccacttaacttcacatccatttaacaaacatttaccaagaatctactatgagtgagacaccatgctaggtgccgtgaatacagatacaaaagatcattcctccccacaagtagttcacagtctttgagggaagacaaacatgcaaacattttaaccataatctgctcaataatataatggaggtaagcattggttggaagtatgaaatcataagtgtctaactcctggccgggtgcagtagctcatgcctttaatcccagcactttaggcggccaaggtgggcgaattacttgaggtcaggagatcgagaccagcctggccaacatggcgaaaccccgtctccactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagaaaaaaaaaaaaaaaagaataagtgtctcattcctgaggaaatcaggcaagaccatggagaaaagaacatggagctcagaagtgaatgggagttcatctggacaagttgaagtgggtcattggagacaaagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428608 - DNA, 1387 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccgggtaacaaatgactgccccctcgagcccaccgccacctccaggactatgctcctactcgtgtcccttgagccacccgggccccagtgaccgttaggccgtggccctcaccgagcttttcttcccagcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428609 - DNA, 1534 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagggacaaggaagatggggagtatgcatgaaaatcccttctcatagcggaaagtccccagatgtgtctgaagtcagcaagtcaagaaacagcatcataagcacagcagtcacacatgcggtggtggcaccagaaggactgaaaaggaatggtgggggcagccacttaagaagcagcagggggcacagagctgttattttttaaccatgtgttgtatttctttgatttttaaaaagtcgagacaattttaaataaaatctttcttctaattgcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428610 - DNA, 1163 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428611 - DNA, 1242 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428612 - DNA, 1955 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccgggtaacaaatgactgccccctcgagcccaccgccacctccaggactatgctcctactcgtgtcccttgagccacccgggccccagtgaccgttaggccgtggccctcaccgagcttttcttcccagcagggtcgtggccagaacgccggccgggaccatctgcacaggcgctcgacagctccaagacgctgcggccaagcagaaagttgaacagaacgcggctcccagccacaccaagttcaggtgagccccacttggaccagccctctggagacccgcaacccctgactcttgcccgacaccctccagagtcagaaccagtgaattttcagctatgtcacttgctatccgtgggaccttatgcaaataaatctgagcctcagccttctcatctaaaaatgcggataatgctgagagaggttgtgagaatcagatgagccgtggtacagagtaaatgttcagtgaacattcgttaaatcaatgagtgaatgtgagatatccataacatgtatcagcgttcttttcttctgagatggagatcttttcagaccaataaccttccctgcctccaaaacaaaatggggaggtagagggcgctagcgatggaacagatgttcctgcacgtcttacggatggtccagggtgggttttgtgctcagccctaggaactggcatcttgcttcccaccagtgccaccacctctgtatgctgtatacacatccacttaacttcacatccatttaacaaacatttaccaagaatctactatgagtgagacaccatgctaggtgccgtgaatacagatacaaaagatcattcctccccacaagtagttcacagtctttgagggaagacaaacatgcaaacattttaaccataatctgctcaataatataatggaggtaagcattggttggaagtatgaaatcataagtgtctaactcctggccgggtgcagtagctcatgcctttaatcccagcactttaggcggccaaggtgggcgaattacttgaggtcaggagatcgagaccagcctggccaacatggcgaaaccccgtctccactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagaaaaaaaaaaaaaaaagaataagtgtctcattcctgaggaaatcaggcaagaccatggagaaaagaacatggagctcagaagtgaatgggagttcatctggacaagttgaagtgggtcattggagacaaagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgcggaattggtgtcgaaaagagaagagtgttgtgt

SEQ ID NO: 428613 - DNA, 718 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggattcccagaagtaagctttgcatctcttacaagaggggagctacaggggcagccgtggcctaggcccaaactctgctctgagaaaataaatatctgtaccacctgt

SEQ ID NO: 428614 - DNA, 551 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacactgtcgagattcggtacgcctcgatc

SEQ ID NO: 428615 - DNA, 476 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgcaacgagggtgctgctcgagttatcgggaccctgttgggaactgtcgacaacactcacgtggaggtcaccattgcttttcgtgc

SEQ ID NO: 428616 - DNA, 602 bp, Homo sapiens
gactggtgagcgctgtggtaaagcatgtgcccagatcgctgggagcccatcaggggatcccgaacctagcagggataatctttcctgatgatcattagcacagataatctttagcttcttcaaagaggtgacatctctctgactttgcaggaataatgaggtatcagggaggtggaggcacagcaggtacggggggacattgcaggcagagaaaactgcctgagtaagctacagaagtatgatacccaaggtgtgccaaggtctacaagaagtctttgttcgcagatcgtaaagtgcaaagtggaaagtggtgggtacagtttgagaggggaacagtgtgaaaacctggttaaagggtttgggtggagacctttgtgagagtagaataggattgggattataggtatcaaagccagtgagcatctcacccctccgttcccttctctacgccaccctgtccctctccgaaccctgcctggagacactggatcatcatttctgggaccatgtcattctacttttccttctgttccttccagtctgccatgcacggactgatcatgggcggcctggaagtgatctcaatcacagacaacacccca

SEQ ID NO: 428617 - DNA, 1168 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtaaaaccacagaaaaaaaaaacagggactttaacgg

SEQ ID NO: 428618 - DNA, 1262 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428619 - DNA, 1180 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagcgggccagccaactgttcgggaaatattttgccctgtaaaaaaaggggcgtaatcccaggccagtacgacagtttgaaagcaaggggaaaagagcggaagg

SEQ ID NO: 428620 - DNA, 2328 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcaggtgagccccacttggaccagccctctggagacccgcaacccctgactcttgcccgacaccctccagagtcagaaccagtgaattttcagctatgtcacttgctatccgtgggaccttatgcaaataaatctgagcctcagccttctcatctaagtaaatgttcagtgaacattcgttaaatcaatgagtgaatgtgagatatccataacatgtatcagcgttcttttcttctgagatggagatcttttcagaccaataaccttccctgcctccaaaacaaaatggggaggtagagggcgctagcgatggaacagatgttcctgcacgtcttacggatggtccagggtgggttttgtgctcagccctaggaactggcatcttgcttcccaccagtgccaccacctctgtatgctgtatacacatccacttaacttcacatccatttaacaaacatttaccaagaatctactatgagtgagacaccatgctaggtgccgtgaatacagatacaaaagatcattcctccccacaagtagttcacagtctttgagggaagacaaacatgcaaacattttaaccataatctgctcaataatataatggaggtaagcattggttggaagtatgaaatcataagtgtctaactcctggccgggtgcagtagctcatgcctttaatcccagcactttaggcggccaaggtgggcgaattacttgaggtcaggagatcgagaccagcctggccaacatggcgaaaccccgtctccactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagaaaaaaaaaaaaaaaagaataagtgtctcattcctgaggaaatcaggcaagaccatggagaaaagaacatggagctcagaagtgaatgggagttcatctggacaagttgaagtgggtcattggagacaaagcatttaccctcccattccaggagaggagagctctctgaggtgggcaggaaagaaatttgaggagatcccaattgcacacattaaagcatcccacaacaacacacagatccaggtagtctctgctagtaatgagccccttgcctttgcttcctgtggcacagagggatttcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428621 - DNA, 1193 bp, Homo sapiens
agtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcatttaccctcccattccaggagaggagagctctctgaggtgggcaggaaagaaatttgaggagatcccaattgcacacattaaagcatcccacaacaatcggaatgccaagaagggcacaggcatcgcagcacagacagcaggcatagccgcagcggcgagagctaaacaaaagggcgtgatccacatccgagttgtggtgaaaggcctggggccaggacgcttgtctgccatgcacggactgatcatgggcggcctggaagtgatctcaatcacagacaacaccccaatcccacacaacggctgccgccccaggaaggctcggaagctgtgatgggaaggaggcctgcacttggacctgacctcaagcctcagctccagtgggaccttgtaaaatgctccctgtcagagctctccagaatatgcttgttggagatccttcaggcagtaagggagagttttgcctccttacacagtggcctttgcttgcacctccagctggagatgggtgtgccccagaagtaagctttgcatctcttacaagaggggagctacaggggcagccgtggcctaggcccaaactctgctctgagaaaataaatatctgtaccacctgtcataattttgagattttttgctttcagagttacgtaattcctaattcctcttgaaaaagagagtgtgaaatgaggtgaggcctcagatgaaagtaaaatataaatgtgagttgctatttaccagacact

SEQ ID NO: 428622 - DNA, 1319 bp, Homo sapiens
ctgccttgctcacctctgacattagcagagcttgtttccttacctgtaaaacaaaggtggcgggttagctgtgaggtttaaatgacttccatgtaaagagttagaagagagcctgcaatgagtgctaagcacattcaccgtttgttttctcacgggttttctgttacactcctccgagtgcagagaggcagctcccttgtgaagctatccacacggtcttccgcctctcgcttgcctgtctcctgtctctccagggaggtgctggctgctgttgggctgagtcctcttggaacttccttgggtttcttacaccaacattaaagactgaagtaatctcccaccgcagccccagcctcaaactactgctcctattgttccagccatcatttctacaccctggggtggttgttcacattcctggctcactcatctatcttccttcctccccaaagctattcccctgacattcaggcacactccttccccctcatgcttagatatgtgtccccagtccctctggatatccctgccaaatgtatcttgctaaaccccccttttaaattgggacacatccctctagtggatatctggatgctgccctgtgtctagggatcaagcccaactcttccacttgtgtaacttatggtgctgcttcctgtggtcatctcagttcccacagttcctaacccttcttcccactgcacagctcctcctcatcccacctctgaaagaccacatccaacctcagacaccaggactacagccaaaaatggaaaaaaaccttagtattgaatccaagatgtgatcaattataagctgcaccatcactttatgtgccactaagagcacagtccattaacagtgatacacccttgtaaaataaatctgatttctgagatgttacggcacggggaaagtgctggaactaagccttcctggctcctgaatactccaagaaacagggtagtgtgggaagctgagtaacagccctcaaaagatggtcacgtcctaatccctggaatttgtgagtgtcgctttatatggcaaaaagaacgctgcagatgtggtaaaatggaggatcttcgctggtggaggactatccataaggccctaaatgccatctccagtatccttaaaaacggaggaagtccagcctgggcaacacagtgagactccatctctacaaaaaatgtttaaaattagctaattagctgggtgtggtggtacaggcctgtagtcccagatactcgagaggctgaagtggaagggttgcttgagtccaggaggtcgagactgcagtgagctatgatcacacaacc

SEQ ID NO: 428623 - DNA, 607 bp, Homo sapiens
ctctaaaaatgttgacagcatgattatcacactcctctgctgtttgaggggcagggagcatttggagatgccttgtttcaggaacccattcagccaagttgtcctggcaagccgtacctcccacagccccctccacaccggctgtttgtccaatctaactttgcactggagcaagatgtgttttcccaggatgaggaaaggaaggttagcccacactgctggatgtggaaggggatgggaaccagggaaagaatggtaactggggaggaagggaaaccatgatacttttgtagtcgaaggcctaactgggcgcactctgccataacttggcccctctgcttcctttccactgggagtgccagaaatcacagggcagcagtcgctcaccctgcctttgtagacaagaaaatgaaaccatcgaagggtgaatttcagctagcatattgccatcactcttttatggtataaaggatgagagaggcggtgagggagacattgccccaaacatgatgtccacatcctaagacttacctgatatttcttattacacaaagacaacattgactggtttaagagagaaaaaaaagtcgacgcaatccagaagaat

SEQ ID NO: 428624 - DNA, 321 bp, Homo sapiens
gactatttggcggctggttcctaacgcttggaggaaactgcagagcaaaaaaccacctgcgagaaagaatcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccaca

SEQ ID NO: 428625 - DNA, 431 bp, Homo sapiens
atacctacattagatttatcgatagaatactcatagccaacattgagtgttacctcacttgggaataaattagagtggattagaaatatataaaatgatttaaaaatctgagcctgttttgaagctctttttttttcctttttatttaattactatttatcttctttcttttttctttttttttcagaggtctcactatgttgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccaca

SEQ ID NO: 428626 - DNA, 1741 bp, Homo sapiens
agcgggggtgttacggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagagatggggtttcaccaagttggctaggctagtcttgaactcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccaca

SEQ ID NO: 428627 - DNA, 1221 bp, Homo sapiens
agcgggggtgttacggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaagtca

SEQ ID NO: 428628 - DNA, 1828 bp, Homo sapiens
  misc_feature (1769)..(1769): n is a, c, g, or t
  misc_feature (1791)..(1791): n is a, c, g, or t
  misc_feature (1799)..(1799): n is a, c, g, or t
  misc_feature (1803)..(1803): n is a, c, g, or t
  misc_feature (1809)..(1809): n is a, c, g, or t
  misc_feature (1825)..(1825): n is a, c, g, or t
agcgggggtgttacggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagagatggggtttcaccaagttggctaggctagtcttgaactcctgacctcaggtgatccacccgccttggcctcccaaagtgctgggattacaggtgtgagccactatacccgaccagatcaaatctttttttgacatttttgcaaaaaaattttcctaatgttcttgatttaattgtatagaatttgtataattaggtgtattttatttgcgtctagctttgaggtatcataatttatgtatcttatgtgaattttttgctgtaataccaataaagttttttttctccacaaaaaaaaaaaaaaaaaaaaaaaaaaaanaaaaaaaaaaaaaaaaaaaaanaaaaaaanaaanaaaaanaaaaaaaaaaaaaaanaaa

SEQ ID NO: 428629 - DNA, 1503 bp, Homo sapiens
agcgggggtgttacggggacactggcccgactactttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttgcagttattggagccctgttacagagcagtggacctgagaggactgcacttttcatcagggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactgtgataaaaagttgattgcagaaggacctggggaaacagtattggttgcagaagaagaggctgctcgagtggcccttagaaaactttatggattcacagaaaatagacggccgtggaactattccaagcccaaagaaaccttgagagcagaaaagagcatcactgccagctagccgccatggatgcagcagcctgaaacttgagagcgaaagtgagataaatgtcaaaggtgtttcaagccagacattttcacaattgtgaagaaatagatgttttgtttctgttttttactgtgttcccaaaattaaataaatgttaaccaagtcacagtgtttttggttttgtttttctgaaatcttggtttgatcaaatctttttttttttctcttgagatggagtcttactctgtcgcccaggctggactgcagtggtgcgatctcggctcactgcaacctccacctcacaggttcaagcgattctcgtggctcagcctcctacttgggaggccgaggcaggagaatctcttgaacctcggaggcggaggttgcagtgagccaagatcatgccactgtactccagcctgggcggcagagcaagactctgtatcag

SEQ ID NO: 428630 - DNA, 746 bp, Homo sapiens
ctctcaccattagcaaccttgcatcccatgggcccttcttctatggccacatgtctctgtggctctttccttcccccttctcttccactgttaaggactcatgtgcttacttagtcctgaatggagacaccgtcatcatccacatgagcccactgtcctaatccatacaggctgctacaaggaaatgcattagaccaggtagcttataaataacagaactttgtttctcacagtcctggaggctgagaagtgcaagatcaaggtgccggcagtcttggtgtctggtgaaggcctgctttctcatagaggcttccttcttgctgtgtcttcgcatggtgagaggaacaaacaagctcccttgtgcctttaataaggtgctaatcccagtcatgagggcagagtctcccgtaaggcttaacctcctaatgccatcaccttgagggttaggattttaacacatgaacagtgacggaacacaacgttcattccatagcaccagggtagtctcctcatgtcaaggtctttacctgaatcacatgcatgatgtaccgttttcatgtaaggttctaggaatctgtggacatctttggggggccattattttgctgatcacatattacatattttttaatattctagactagtatgaaaacaatgccacttccattgctttatatacgtatctatatacacattgtctattgctataattaaaaaaaagttgtagacacaaatatacccattta

SEQ ID NO: 428631 - DNA, 961 bp, Homo sapiens
ctctcaccattagcaaccttgcatcccatgggcccttcttctatggccacatgtctctgtggctctttccttcccccttctcttccactgttaaggactcatgtgcttacttagtcctgaatggagacaccgtcatcatccacatgagcccactgtcctaatccatacaggctgctacaaggaaatgcattagaccaggtagcttataaataacagaactttgtttctcacagtcctggaggctgagaagtgcaagatcaaggtgccggcagtcttggtgtctggtgaaggcctgctttctcatagaggcttccttcttgctgtgtcttcgcatggtgagaggaacaaacaagctcccttgtgcctttaataaggtgctaatcccagtcatgagggcagagtctcccgtaaggcttaacctcctaatgccatcaccttgagggttaggattttaacacatgaacagtgacggaacacaacgttcattccatagcaccagggtagtctcctcatgtcaaggtctttacctgaatcacatgcatgatgtaccgttttcatgtaaggttctaggaatctgtggacatctttggggggccattattttgctgatcacatattacatattttttaatattctagactagtatgaaaacaatgccacttccattgctttatatacgtatctatatacacattgtctattgctataattaaaaaaaagttgtagacacaaatatacccatttaaaaaaaaaattttttttgctattttacttcatactgccaactcctttttcctgaaactgcttcaactctggaattcttttttgctattagttttattttattgaaatattcatgaatgagcatacacttgtatatggatttaaaattcacagtaatgttctcatgagttcatctgtgaataacattttatagacaaaatgtctgcactaagacaa

SEQ ID NO: 428632 - DNA, 8382 bp, Homo sapiens
tattagccaagctaagttactcttttgcctcctgttgttactcaagtcttttctcttctgtccttctgccagccttaccccactccttaatcctctgaaccagcaaaccattgccaagttctgatgcaaagtggtttataggcctgactggaccagactaaaagtgttcaaaatagcaagcaacaaggagcagaaatccatattagaatgggatatggactatatttatattggtacagaatgccttcaataaagagttgtgagttgtgtaggtgagttgccatggagctacaaatatgagttgatattctgaaatcctagacagccatctccaaggttaagaaaaatccttatgcactcacttgcaaagatatccacagcatgctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacaggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccgtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatccta

SEQ ID NO: 428633 - DNA, 9786 bp, Homo sapiens
tattagccaagctaagttactcttttgcctcctgttgttactcaagtcttttctcttctgtccttctgccagccttaccccactccttaatcctctgaaccagcaaaccattgccaagttctgatgcaaagtggtttataggcctgactggaccagactaaaagtgttcaaaatagcaagcaacaaggagcagaaatccatattagaatgggatatggactatatttatattggtacagaatgccttcaataaagagttgtgagttgtgtaggtgagttgccatggagctacaaatatgagttgatattctgaaatcctagacagccatctccaaggttaagaaaaatccttatgcactcacttgcaaagatatccacagcatgctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacaggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccgtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacagacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaattttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatctcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatccta

SEQ ID NO: 428634 - DNA, 5249 bp, Homo sapiens
ctccttatgctcatccctccttcctcatccctccttatgctcatccctccttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccgtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatccta

SEQ ID NO: 428635 - DNA, 405 bp, Homo sapiens
cactgaaagcaaagtgggtgttcacatcaacatcacacagaccaagatgagccaaatcgatatttcctcaggtcagtgaaacctatttgacatttgttcctgaaacttattgcaatttccagagttaatgttgtgctttgtttggttttgctggtgttacacgctcaggattaggttttaattcagatcttcaagacgcttacttggttgtagtgtgtgctgattgaataaagaaaacttggaaagttgttgagagagcaaggcatgggtgaaggagaaaattggttgagattggaaaagcaaaatctattccttaccaatgctagtttatttttaatagataaattgctcttcttttaagtgaataatttatgtttaaaaacaaggaatgtttattttaaaaac

SEQ ID NO: 428636 - DNA, 8106 bp, Homo sapiens
  misc_feature (7)..(7): n is a, c, g, or t
  misc_feature (26)..(26): n is a, c, g, or t
tgagggnagaagaggaagcgggaggngcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacaggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccgtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatccta

SEQ ID NO: 428637 - DNA, 4657 bp, Homo sapiens
cggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccgtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatccta

SEQ ID NO: 428638 - DNA, 3018 bp, Homo sapiens
tattagccaagctaagttactcttttgcctcctgttgttactcaagtcttttctcttctgtccttctgccagccttaccccactccttaatcctctgaaccagcaaaccattgccaagttctgatgcaaagtggtttataggcctgactggaccagactaaaagtgttcaaaatagcaagcaacaaggagcagaaatccatattagaatgggatatggactatatttatattggtacagaatgccttcaataaagagttgtgagttgtgtaggtgagttgccatggagctacaaatatgagttgatattctgaaatcctagacagccatctccaaggttaagaaaaatccttatgcactcacttgcaaagatatccacagcatgctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcct

SEQ ID NO: 428639 - DNA, 591 bp, Homo sapiens
  misc_feature (564)..(564): n is a, c, g, or t
aactgagctaacaagaaatactagaaaaggaggaaggagaacattgctgcagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacaggtaagatgaatgtttccaggcttttcttatacttatttttgctatagtaaagtgattgaatttgtatgttcgcttcctttaaataaacaactttgcattaaaggacnacgcggccgcgaatttagtagtagtaa

SEQ ID NO: 428640 - DNA, 4202 bp, Homo sapiens
aactgagctaacaagaaatactagaaaaggaggaaggagaacattgctgcagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacagaatcggatttcatcacatgacaacatgaagctgtggattcatctcttttattcatctctccttgcctgtatatctttacactcccaaactccagtgctctcatccagaggctcttgtgattctctttgcaattgtgaggaaaaagatggcacaatgctaataaattgtgaagcaaaaggtatcaagatggtatctgaaataagtgtgccaccatcacgacctttccaactaagcttattaaataacggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgacttattgcagttaaaaacttggttggagaacatgcctccacagtctataattggtgatgttgtctgcaacagccctccattttttaaaggaagtatactcagtagactaaagaaggaatctatttgccctactccaccagtgtatgaagaacatgaggatccttcaggatcattacatctggcagcaacatcttcaataaatgatagtcgcatgtcaactaagaccacgtccattctaaaactacccaccaaagcaccaggtttgataccttatattacaaagccatccactcaacttccaggaccttactgccctattccttgtaactgcaaagtcctatccccatcaggacttctaatacattgtcaggagcgcaacattgaaagcttatcagatctgagacctcctccgcaaaatcctagaaagctcattctagcgggaaatattattcacagtttaatgaagtctgatctagtggaatatttcactttggaaatgcttcacttgggaaacaatcgtattgaagttcttgaagaaggatcgtttatgaacctaacgagattacaaaaactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacacctcctccaagttttaccaccacatattttttcaggggttcctctaactaaggtaaatcttaaacaaaccagtttacccatctacctgtaagtaatatttggatgatcttgatttactaacccagattgaccttgaggataacccctgggctgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgccactgtctgttctaatattgggacttctgattatgttcatcactattgttttctgtgctgcagggatagtggttcttgttcttcaccgcaggagaagatacaaaaagaaacaagtagatgagcaaatgagagacaacagtcctgtgcatcttcagtacagcatgtatggccataaaaccactcatcacactactgaaagaccctctgcctcactctatgaacagcacatggtgagccccatggttcatgtctatagaagtccatcctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagcagcaaacatagatggagagtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaagggttatagtaatatttcatatactgaaaagtgtctcataggagtcctcttgcacatctaaaaaggctgaacatttaagtatcccgaattttcttgaattgctttccctatagattaattacaattggatttcatcatttaaaaaccatacttgtatatgtagttataatatgtaaggaatacattgtttataaccagtatgtacttcaaaaatgtgtattgtcaaacatacctaactttcttgcaataaatgcaaaagaaactggaacttgacaattataaatagtaatagtgaagaaaaaatagaaaggttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaagagagggacaatgtagctttattttacaagaaggcatagttagatttctatgaaatatttattctgtacagttttatatagttttggttcacaaaagtaattattcttgggtgcctttcaagaaaattaaaaatactactcactacaataaaactaaaatgaaaactcttt

SEQ ID NO: 428641 - DNA, 3272 bp, Homo sapiens
aactgagctaacaagaaatactagaaaaggaggaaggagaacattgctgcagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacagaatcggatttcatcacatgacaacatgaagctgtggattcatctcttttattcatctctccttgcctgtatatctttacactcccaaactccagtgctctcatccagaggctcttgtgattctctttgcaattgtgaggaaaaagatggcacaatgctaataaattgtgaagcaaaaggtatcaagatggtatctgaaataagtgtgccaccatcacgacctttccaactaagcttattaaataacggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgacttattgcagttaaaaacttggttggagaacatgcctccacagtctataattggtgatgttgtctgcaacagccctccattttttaaaggaagtatactcagtagactaaagaaggaatctatttgccctactccaccagtgtatgaagaacatgaggatccttcaggatcattacatctggcagcaacatcttcaataaatgatagtcgcatgtcaactaagaccacgtccattctaaaactacccaccaaagcaccaggtttgataccttatattacaaagccatccactcaacttccaggaccttactgccctattccttgtaactgcaaagtcctatccccatcaggacttctaatacattgtcaggagcgcaacattgaaagcttatcagatctgagacctcctccgcaaaatcctagaaagctcattctagcgggaaatattattcacagtttaatgaagttccatcctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagcagcaaacatagatggagagtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaagggttatagtaatatttcatatactgaaaagtgtctcataggagtcctcttgcacatctaaaaaggctgaacatttaagtatcccgaattttcttgaattgctttccctatagattaattacaattggatttcatcatttaaaaaccatacttgtatatgtagttataatatgtaaggaatacattgtttataaccagtatgtacttcaaaaatgtgtattgtcaaacatacctaactttcttgcaataaatgcaaaagaaactggaacttgacaattataaatagtaatagtgaagaaaaaatagaaaggttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaagagagggacaatgtagctttattttacaagaaggcatagttagatttctatgaaatatttattctgtacagttttatatagttttggttcacaaaagtaattattcttgggtgcctttcaagaaaattaaaaatactactcactacaataaaactaaaatgaaaactcttt

SEQ ID NO: 428642 - DNA, 1062 bp, Homo sapiens
ccaaagtggctgagccatcatgcccagccctcccttattttcttaatcgcattttattagagctggcatgtgaatttaatttgccatttttcagtttcctttaatttacatattaaagaattgtaacagttctttaccaatgaatcaaaaccattcacttgaattaattttctccaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacacaccgcaccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgataaaggacagaaaagatcggctgcctctagagagtgcagtggttagaggca

SEQ ID NO: 428643 - DNA, 640 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacacttattctcgtgcccaattccttcaacccgggggatccacttgtttctagagcggtcggcacccgtggttgagcttccagcttttgttcccttttgtggagtgtaatttatg

SEQ ID NO: 428644 - DNA, 672 bp, Homo sapiens
aaaatctaataagtagatggcccttgaccatagacacgtcccccgggagccctagcacggatctcagtattgttacaaaccaagggagaccggggactcagtgtgaagcgacaggcactaggctgggagtgtgaggtaggcctttgattccattcagcgagcctgatgtttctccaattctgagcttctgggatttttattattttggcaaataagtctccttaaatggctcaccaagaaagtttggacctttgtgtccaagtggcttgattttatctcacttgacaaaatttgggagagcagattagggacctggattttctgtaatgtggatgtccctgttaatggccgagtaggaaactaggccatgatcggactctacccagtgctgggtagaggacattttcacggagagctcacagaaatcaacattctcccctctgtctagggaagcagggcacttcttaaaggttgaaaaatagaaagcagccttcactgcctaccttttaatataatagtgatcggtttcctcatttttcttgatagtaagaaattaagggttaacatcaatgtgccaatgaaaaccgaacagaagcaggaacaagaaaccacacacaaaaacatcgaggaagaccgcaaactactgattcaggtgacttatctgtatgcctg

SEQ ID NO: 428645 - DNA, 771 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtgagtgtcggcagccgccggggccgagaggaggtggcggcggcggcggcggcgcaggcccggccccgagccgcggtgtcgcagtgactcgggccgcgacggccgaaaccaggcgcctggcgaggcctgagccgccgaaacgcggccgggcagaatggcggccgggccgggggactcgtgggcggaggacgccgaaggtggcagaggagcgagcggggccgggccctgagtcaccccggacgggccggggcggccaggcctggactacgcactgggaaaaagcacgattcatcgcgcctggaggcggcggcctggtggcgccggcccctttccccgccgcgaccgggctgggttctcggagggtgggccgacgtgtggcccggggcggctcgggcgtccgcgcctcgcctggtgaggcgacctccgcgggacgccgggacccgtgcccttgccccctcgcgcccacgcttcttcccggcgctgctttccggccgacgcgtgttcccctgtgagctctgggctcaagcgcaggagcagccgcggagccgggctctctcgctttccggt

SEQ ID NO: 428646 - DNA, 3230 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428647 - DNA, 4580 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtgcgttccggccctcccccaacagcttctcccccgcggtcgccggagccggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccatttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428648 - DNA, 4076 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccatttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428649 - DNA, 3406 bp, Homo sapiens
tgccccgttctcctgggagagcgggccggggcatgcgcgcagggatgctagcccggcggccgaaccggacagagccccccggcgcccgcctatcgctcgctagtcgggccgggccctgcgctgcggcctcggcgcgcccccggtcccaacgggagcgcgcgccctgaccctgagggtagccgtgcgcccgccaggccgctgggacttggggtccccagactcgggggtcgtcgcttttttttcccttaagatctgaaagacccccgtttctgccacccgtgcagtattgtgtagcgcagacataagataagaaagagaggaatgcttgtagacattccttgaaatgaatccccaaagttagggttttctccctggctggctttgccaaaaagaggattctcttttccgattgggtcactcttggttgcttctggttcgtagtaggggttagtggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccatttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428650 - DNA, 4653 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtgcgttccggccctcccccaacagcttctcccccgcggtcgccggagccggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428651 - DNA, 4149 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428652 - DNA, 4602 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428653 - DNA, 3175 bp, Homo sapiens
  misc_feature (3146)..(3146): n is a, c, g, or t
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggaaaaaaanaaaaatactggcctcttgtggcctcagcg

SEQ ID NO: 428654 - DNA, 3179 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428655 - DNA, 3193 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacagcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428656 - DNA, 3080 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccatcagattcagcactctctattaccagcacatcatcacaatcccagcaccttgtaatcacataatgctgacagatactcaccagaatccg

SEQ ID NO: 428657 - DNA, 2760 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaaccctcttgtaggctacttttacccgaaatgtatttggagaattaacacctcagtcatagcagcc

SEQ ID NO: 428658 - DNA, 2823 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaaggtacaggactttacatagcagtcacattcctttcttaatttagaagataaaagatgtagcaaaaagtggattgattgctgtagcatgaaggaggagggagctgacttctttgtatgtagatttctataaaagaaagtcggcttcagtttaactgttgaaacacacatacaaagtgcacagatgatgaagtgccagcttgatgactttc

SEQ ID NO: 428659 - DNA, 1209 bp, Homo sapiens
tcccgtccaagttgatcctctatagtcaaccgtattcagcattcactattgccaactcggccagacgggtcacaacattcgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428660 - DNA, 1106 bp, Homo sapiens
ggtggttattgcaaagaaaaatgcattttccctttaacttcctctttttctctttaattgcaggacattttggcgcaagttttacagattttattaaagtcgaagctattggtaggtttgcgcccttttatcttacactagaagaagccttttcctgagattgtagagtaacaattgttttcttacaggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428661 - DNA, 1381 bp, Homo sapiens
aaaatctaataagtagatggcccttgaccatagacacgtcccccgggagccctagcacggatctcagtattgttacaaaccaagggagaccggggactcagtgtgaagcgacaggcactaggctgggagtgtgaggtaggcctttgattccattcagcgagcctgatgtttctccaattctgagcttctgggatttttattattttggcaaataagtctccttaaatggctcaccaagaaagtttggacctttgtgtccaagtggcttgattttatctcacttgacaaaatttgggagagcagattagggacctggattttctgtaatgtggatgtccctgttaatggccgagtaggaaactaggccatgatcggactctacccagtgctgggtagaggacattttcacggagagctcacagaaatcaacattctcccctctgtctagggaagcagggcacttcttaaaggttgaaaaatagaaagcagccttcactgcctaccttttaatataatagtgatcggtttcctcatttttcttgatagtaagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428662 - DNA, 2039 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacacaccgcaccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgataaaggacagaaaagatcggctgcctctagagagtgcagtggttagaggca

SEQ ID NO: 428663 - DNA, 1076 bp, Homo sapiens
ggtgacttccccaacaggcaggaggcccagtgtccctcctgggttacatttggcacaggtgccagttcgttcatggctgttcagggagttccccacagtcccctgttccctgttcatggcctcttcttgtgagactgagtcctgccgcagaggcaggcagattttggtggtagaaagggagactggcccacggggctcccgaagcacctgactccagttcctagggcgggtgcaggagggactcggagtcaccctcagcaagtgtcagggagctccgtgcatgaaggcttagctgccaggaagtaaaactctatgctaacagatctggggcggggacactgctccccactgagctccgaatcaggggagatttgtggtgggggcagcctctctctgttctgatgataatttgtgtttttcttctctttcactacctcttcctttttaaaaataacacccagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428664 - DNA, 967 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacagacaaatgctgttttaagctgagttgattgggttggctcagtcgaacgaactgggtatcctctagaaca

SEQ ID NO: 428665 - DNA, 3236 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtgcgttccggccctcccccaacagcttctcccccgcggtcgccggagccggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcaggttgattgcttagagttttgattatttactagtatgacttatgaattattagaattttatattgttttctcctcccagttcatcatgtaaaataatcgcagggttcatttttagccttaagtttttgaacagagtagaactggttcatttttagtcaaatgcagcactgggcagtacagtcaccactgggcacatgtggctgtttacatttgaaatattttaaagttccttaggcacactagctgtgtgattaataaataaaacatttctgtcatgtagaaggttccgttgggcaaagctggtctaaagcaaggtcctgaggttctcagcagatcatttgttttacgtccatttgtttatatattgtctatgactgccttgtgttatgggaacagagttaagtagttgtgtcagaaacagttttgtccatgaagcctaaaatatttactacctgcccttttacaggaaaagtttgtttacctgatcaaaagggatagaacatcgagcaaaagttttcctgttatggccctatttttttgtgtttttgagacaaggtctcgctctgtcacccaggctggagtgcagtggtatgatcacagctcaccgcagcctcaactacctgcactcaagcaatcctcccatctcagcctcccaagtagctgggaccacagacacgtgccaccacacctggccaattttttttttattgtttatagagacagagtcttgctatgttgcccgggctgtggccctattttttaaagtacagtatttaaaaagaattttattcctttagtttttggtccacgatgtgcatgggggactgtgctgtgtgccacaaaggtgatgagggtggaaaagatgcggctcccactattcgtgtggttggagatgcaccagctaatttggaggctttcttgattccatacaaatatgacattgaaattagagttaagctcactcaggagagaggagattgccactgtttctaggactttaaagttgctgattcaacggagcttcaggtttaaagtcttcaggtttgatagactatatcagttctatcaaactagtttttgtgatattccagtatgttcttgcatgttaatattttagaatcctaaaaaaaatttaagtagatataaaactatgtcaatctctgaattagcataaaatgtgtgtttgcatatttatacatgtatatacacttacatatagaatacttttaaaataatagctttattgagatgtaattatgtaccataaaattcaaccttttaaaaagta

SEQ ID NO: 428666 - DNA, 1813 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcaggttgattgcttagagttttgattatttactagtatgacttatgaattattagaattttatattgttttctcctcccagttcatcatgtaaaataatcgcagggttcatttttagccttaagtttttgaacagagtagaactggttcatttttagtcaaatgcagcactgggcagtacagtcaccactgggcacatgtggctgtttacatttgaaatattttaaagttccttaggcacactagctgtgtgattaataaataaaacatttctgtcatgtagaaggttccgttgggcaaagctggtctaaagcaaggtcctgaggttctcagcagatcatttgttttacgtccatttgtttatatattgtctatgactgccttgtgttatgggaacagagttaagtagttgtgtcagaaacagttttgtccatgaagcctaaaatatttactacctgcccttttacaggaaaagtttgtttacctgatcaaaagggatagaacatcgagcaaaagttttcctgttatggccctatttttttgtgtttttgagacaaggtctcgctctgtcacccaggctggagtgcagtggtatgatcacagctcaccgcagcctcaactacctgcactcaagcaatcctcccatctcagcctcccaagtagctgggaccacagacacgtgccaccacacctggccaattttttttttattgtttatagagacagagtcttgctatgttgcccgggctgtggccctattttttaaagtacagtatttaaaaagaattttattcctttagtttttggtccacgatgtgcatgggggactgtgctgtgtgccacaaaggtgatgagggtggaaaagatgcggctcccactattcgtgtggttggagatgcaccagctaatttggaggctttcttgattccatacaaatatgacattgaaattagagttaagctcactcaggagagaggagattgccactgtttctaggactttaaagttgctgattcaacggagcttcaggtttaaagtcttcaggtttgatagactatatcagttctatcaaactagtttttgtgatattccagtatgttcttgcatgttaatattttagaatcctaaaaaaaatttaagtagatataaaactatgtcaatctctgaattagcataaaatgtgtgtttgcatatttatacatgtatatacacttacatatagaatacttttaaaataatagctttattgagatgtaattatgtaccataaaattcaaccttttaaaaagta

SEQ ID NO: 428667 - DNA, 2062 bp, Homo sapiens
tgccccgttctcctgggagagcgggccggggcatgcgcgcagggatgctagcccggcggccgaaccggacagagccccccggcgcccgcctatcgctcgctagtcgggccgggccctgcgctgcggcctcggcgcgcccccggtcccaacgggagcgcgcgccctgaccctgagggtagccgtgcgcccgccaggccgctgggacttggggtccccagactcgggggtcgtcgcttttttttcccttaagatctgaaagacccccgtttctgccacccgtgcagtattgtgtagcgcagacataagataagaaagagaggaatgcttgtagacattccttgaaatgaatccccaaagttagggttttctccctggctggctttgccaaaaagaggattctcttttccgattgggtcactcttggttgcttctggttcgtagtaggggttagtggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcaggttgattgcttagagttttgattatttactagtatgacttatgaattattagaattttatattgttttctcctcccagttcatcatgtaaaataatcgcagggttcatttttagccttaagtttttgaacagagtagaactggttcatttttagtcaaatgcagcactgggcagtacagtcaccactgggcacatgtggctgtttacatttgaaatattttaaagttccttaggcacactagctgtgtgattaataaataaaacatttctgtcatgtagaaggttccgttgggcaaagctggtctaaagcaaggtcctgaggttctcagcagatcatttgttttacgtccatttgtttatatattgtctatgactgccttgtgttatgggaacagagttaagtagttgtgtcagaaacagttttgtccatgaagcctaaaatatttactacctgcccttttacaggaaaagtttgtttacctgatcaaaagggatagaacatcgagcaaaagttttcctgttatggccctatttttttgtgtttttgagacaaggtctcgctctgtcacccaggctggagtgcagtggtatgatcacagctcaccgcagcctcaactacctgcactcaagcaatcctcccatctcagcctcccaagtagctgggaccacagacacgtgccaccacacctggccaattttttttttattgtttatagagacagagtcttgctatgttgcccgggctgtggccctattttttaaagtacagtatttaaaaagaattttattcctttagtttttggtccacgatgtgcatgggggactgtgctgtgtgccacaaaggtgatgagggtggaaaagatgcggctcccactattcgtgtggttggagatgcaccagctaatttggaggctttcttgattccatacaaatatgacattgaaattagagttaagctcactcaggagagaggagattgccactgtttctaggactttaaagttgctgattcaacggagcttcaggtttaaagtcttcaggtttgatagactatatcagttctatcaaactagtttttgtgatattccagtatgttcttgcatgttaatattttagaatcctaaaaaaaatttaagtagatataaaactatgtcaatctctgaattagcataaaatgtgtgtttgcatatttatacatgtatatacacttacatatagaatacttttaaaataatagctttattgagatgtaattatgtaccataaaattcaaccttttaaaaagta

SEQ ID NO: 428668 - DNA, 1664 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtgcgttccggccctcccccaacagcttctcccccgcggtcgccggagccggtgaggccgagagggcggggagccgcgcagggaaggc

SEQ ID NO: 428669 - DNA, 2102 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtgcgttccggccctcccccaacagcttctcccccgcggtcgccggagccggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcagaggaaaggccatgtgaggacacagtgagaaggtggccgtctgcaaccctggaagagagccctcaccagaaaccaaccctgacagtaccttgagctcggacctctagtctccagaactgtgagaaaataaattcctgttgtttaagccgtcttg

SEQ ID NO: 428670 - DNA, 465 bp, Homo sapiens
caaagttaaattacagcagactagaaagcaattggtaaagtgaatttcctttactgaagtttaagtggattatcttaaaggcaaacttcttcagaatgtttttggaaatgttttataaatatctcctgttggttttcaccttggatattctaaatgactacttcataatctgttcttcagtgttgaggttacagtatgagattgccagtttgctgtaggtaaggaaagtcaaccttccctcttcctctgcactaatctgatgagaactgatcttttgaatgcttgaagctgcattctggctaagtggtgcttgtttaaacgtactgatgttttaaaacatggtatctttttaaaattttcagttccaagaacccagaggaggcagaactagaagacacactcaatcaagtggtaagtgcttcatgagcatacccatttccagtagctgtgtatttcacaagctgt

SEQ ID NO: 428671 - DNA, 3139 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaagga

SEQ ID NO: 428672 - DNA, 4168 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428673 - DNA, 4430 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428674 - DNA, 3619 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtggtaagtgcttcatgagcatacccatttccagtagctgtgtatttcacaagctgtttgtaatgttatttgtagatggcctctgaaatgtgaaaagtaataatcattgattttattttgaatctctggttttacttcctaaattgagttactacttttagcattcatacttttctcattaatactcagtcagtccaactcactgaattaagggactcacaaaactttcaagactctggagtggagattttgccatcataaacgttggcgtacagacctgcccaaagccaaaggcacatcttggctcctggcttgtggccggtgacagtcagctctgcactgttggcttgtgtgtgtgctggttaagtgtgttgtctcggtggctttgccagatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428675 - DNA, 4551 bp, Homo sapiens
ggtaagattggagaagactggttagggaataggaagataagctgttgtctaaaaaacgcagtctccagtaaaaggaagaaattgggacatttttttaaaaccccacataggtacactggaaaacatgggccacagggataaaccttccatttttacttccaaccttaccatgtgctcacaaaaaaaggtgttaaatacatgtaagttttgacgaggttatttaaaagtgtaggatataaaccaagaatttttcacaccccaaaaccccgcacaaattaagggattacatatctgagtgacaagtacatacaaacgcattacttctagagatacttagatgtagataaaagaccacatttcaatagagggatcacacagaccagtgggatgtttcttctgagataacccactttatgcaggaaacagtgtggactctggggacggcctctgctctggctgaggatttctgtcccagagcggtacaggaatctgcgtagtgttttagtttggagaaaacaggaagttacactcatcacatcttttgcccagatgatagaattcgaaatccccccggggttgttcatggaatgagccgctctgttatgttgtgagccgtggtattaatcagccacccctcactaggtgttggggttccaccacgcttcctccaccccccgtcaccacagcagcgggtagtatttaggttgaatattccaaatagtcaattatgacagttaatttcaaatgagatgacttcgaagtacacgtgaaaacaatactattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggcaagctgggggtgggggtgcgcacaagggaggggcaggggactgggaccccctcttcttcggggtgcttcgggccgtttctccagaggctggtggtgtccccgacccaagcagctcagccccgctcgcgaggtccgaagtggcgggaacgggtcctccgcggcggtcccaaggcgagggaggctgtaaaacctggcagagaatccggcgcgccgggtcggggatgtctcgggtgccgggggcaggggccgcaggctcgcaggtagaagcttccccacgcgagcgggggcctcggccgcggcaggggcgcccccggggccgccggcagcggcgagcgggcgggagggagctttccgggcccctcccgcgcctcgggctggcggggcgatggcgacgacggtttcccggctcccccgccccggacgccgatggcggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428676 - DNA, 2253 bp, Homo sapiens
ccaaagtggctgagccatcatgcccagccctcccttattttcttaatcgcattttattagagctggcatgtgaatttaatttgccatttttcagtttcctttaatttacatattaaagaattgtaacagttctttaccaatgaatcaaaaccattcacttgaattaattttctccaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428677 - DNA, 3305 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggtaagatcacatttttatcttaaaatttttctattctaaatgaacataaggcaaattatggaaatcattatcagctgactcagcagcagaatctagaattcagcttctggtgaaatagtggcaggtttaaagcatggagttgtaagaatcagatgaaccaaattccaattctttctggctggggagcaagttatttaatgattgtgagcctcagttttctcctccattaatgggagtgttagtactttatagttgggaattgatgtgaaaattaaataatgtatttagtaagtgtttggcaccgctcctgcctgacacacatcagctgttcaggtagtgacttcaaaagctggagttgcatgcatttcattatatcagctctccaccttacacagagcactttcacattaataacactcagtgctgacaacaatattgagtacaacctaatttatacctatgtaactaagaatatttccatttcttagaggagaaaactgaggcttgggttaatttaagtgaatttctctgaatcctagcttatatgtagctgagccaaaatttcagttaaagtcttttctcttaaagtctaggcttgggctggtgtggtggctcacgcttgtaatcctcacgctttgggaggctgagaccagagaatcacttgaggctaggagtttgagacaagcctggacaacatagcaagaccccatctctagatattttttaaagtaaaaagaaaaaaaagtccaagctctttctacttccacttttgtactgagtggtcttcacaagtaatggcatattttagtctctgagaagttttcaccagtgagtttctaagaagaattgcaaatctgtgtttaagtattaagaaactccagaatgggttgttctgcagactcaagctgctcattaatttaaacttttcgtaaatctactgtgacttaaaattgttaaaatgcatagtattatgctggctccagaggtctttatcaacttgaatgtttcttactatacaattgaaattttgtttcatttatccccaaatatacatagaagaatccatgtgttccactacagtacctggaatttcagtgtccagtttttgacggtggaggctttgcctagggtgtg

SEQ ID NO: 428678 - DNA, 1312 bp, Homo sapiens
gattgtctctataaatgcgtggggacgtatctatagtatgtatccacatagacaatacgttttttaaaaatgttgcattgtagtggcattgccacgttttatattcccttttaaatagatctgtgctttttttgtacttgtttaaagaatttgtttcataaataagttcttcaaacttgggctgtatattttgggaggtgtttccatgcatgtaaattttccttctttttcttttatatggggggccgcaaaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaatttaaaaaaa

SEQ ID NO: 428679 - DNA, 2163 bp, Homo sapiens
ggcggcggcggcgggaggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtggtaagtgcttcatgagcatacccatttccagtagctgtgtatttcacaagctgtttgtaatgttatttgtagatggcctctgaaatgtgaaaagtaataatcattgattttattttgaatctctggttttacttcctaaattgagttactacttttagcattcatacttttctcattaatactcagtcagtccaactcactgaattaagggactcacaaaactttcaagactctggagtggagattttgccatcataaacgttggcgtacagacctgcccaaagccaaaggcacatcttggctcctggcttgtggccggtgacagtcagctctgcactgttggcttgtgtgtgtgctggttaagtgtgttgtctcggtggctttgccagtagaacttctgaaatacgtctttgtcttctatatacttgaagacaaccatctggcagagcca

SEQ ID NO: 428680 - DNA, 2232 bp, Homo sapiens
  misc_feature (2055)..(2055): n is a, c, g, or t
gcccgggctggcgccgctgggcagagccggtgcgacgtttccctttccagctttgttcttccggccctgctgtctgcctccccggctgattggattcgttactgctttgcaacgcgcacctaactccagacggggtctcactctgtcgcccaggctggagtgcagtggcacaatctcagcttgctgtgacctcagctctctgcgacctctgcttgctggactcaagcgatcctcccaccacctcagcctcctgagtagctggaaccatcatatgcaccagcacgcctggctaagctggaatgcaatagcgtggtcttggctcactgcaacctccgcctcccgggttcaagcaattctcctgcctcagcctcctaagtagctgggactacaggggccctcctgctgctccctccatgaggctggtcctgaaggaataggcctgtggctcgtccctcctccccatctcggccctgaggcaaacataccttccacagctctgggagcaccgcctccacccaggtctcacaggatgggacacaaggataggcattaagcaggacttccagggcccgagggaagttggcgcagtgtttcagcatctaggggtcaaaagagggtcttgggcacatgcctcccccacccgagggcagacccaagtcttgcctcacccacatggccaatcctagcctaatctggggggctaaggtctgagtctctcttcccttttttgtgcctctgtctaccccaccctcaagtatgctccaaccttttggccccagttttcctctggggctcttccctcccttggactctctctcccagaatcctctctccccctcccaagctggggacagccccctggccactgagggcaggctttcagtctcttggaccctctgtcttccccagaagcggagcagttccagccgcgggctcccccacacaggagcctcctatgtcagggcctcccagcgcacctcagggcgcactggctgcgccccgtagtccagcagtgcggcgaaaaggacttcaggctcccagttgggggcgtcctggacggcctgcagcgcacagtccatgggcgtgtggcccgccccattggggacctcagcgcgggccccgtaacgcagcagcagctcggccaggcccccgcagccgctggcacaagcgttgtgcagcggcgtgtggcgcttgcgcccggccgcccgggcatcagctccagcctccaggagccggcgcgccgcagcctggtgtcgcctgcagctacctgggccctcggccccagcgcacgccgcgttcagcgcagtctcgccctggctggtgcgcaggcccacgtcggcgccatgctccaggtacagagccacatgttgctccaggccgcgcgccgccgccacgtgcaggggcgtctcctggctctcgcctgctgccaggttcaccgtcgctcctgcttccagcagcaacttggcgcacctggggacaagagagcaaggtcctgaggaaaatcctgaaggcttgggaccccttcagcttgctgtgacactcccttgcctttccacccctctcagcttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctccttttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcanacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcaccaaaaaaaaataa

SEQ ID NO: 428681 - DNA, 894 bp, Homo sapiens
  misc_feature (717)..(717): n is a, c, g, or t
gcccgggctggcgccgctgggcagagccggtgcgacgtttccctttccagctttgttcttccggccctgctgtctgcctccccggctgattggattcgttactgctttgcaacgcgcacctaactccaggctggaatgcaatagcgtggtcttggctcactgcaacctccgcctcccgggttcaagcaattctcctgcctcagcctcctaagtagctgggactacagcttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctccttttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcanacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcaccaaaaaaaaataa

SEQ ID NO: 428682 - DNA, 2766 bp, Homo sapiens
  misc_feature (2589)..(2589): n is a, c, g, or t
tgatcctcctgcctcagcctcccttgtaggtgggactacacggcacctggcccttgtgttgttcttgtaacagttgctcaatgcagaaaacttggaaaccacagaacagcaccagggggtggggaatgaacatggaatgatggggacctctgtcccatttaagtcaaacaacatccatactttggttccatggactaatcatttatttgcactcataaaaactggcttgctttgaaaagcttcctccaaaagctgtattgtggtacttttgactctgggacaagaggaagaagttggggaattcgggcagttggtggctgggccctcagagactgtatgtggtgaccactgtttaagacaccattcatcacttggggacggagggagcacatagatggaccccaggctcatggatgttcctccttccgcagtcatttactaaaatacctgttcaaggaatatagttccagtctcagcctagttgagacaaccacaggcacttaaataagtaccaaggaagcctctgcagagatagtgctattggaactgagtcctgagggccagatcagccttgaccaggccaaaaaatgtggaagagtattccaagcggtaggaataacacatgcaaacacctgaaagcaaagaggagcaggtcacatccagcaactggtgacttgtttactaaggctggagatgaaccttggaaggaagaagggaagtcaagaggccagataatttggcagaggctagaggctctgttctactgagttgttttctcgtttgttttgttttgttttttgagacagagttttgctcttgtcacccaggctggaatgcaatagcgtggtcttggctcactgcaacctccgcctcccgggttcaagcaattctcctgcctcagcctcctaagtagctgggactacaggggccctcctgctgctccctccatgaggctggtcctgaaggaataggcctgtggctcgtccctcctccccatctcggccctgaggcaaacataccttccacagctctgggagcaccgcctccacccaggtctcacaggatgggacacaaggataggcattaagcaggacttccagggcccgagggaagttggcgcagtgtttcagcatctaggggtcaaaagagggtcttgggcacatgcctcccccacccgagggcagacccaagtcttgcctcacccacatggccaatcctagcctaatctggggggctaaggtctgagtctctcttcccttttttgtgcctctgtctaccccaccctcaagtatgctccaaccttttggccccagttttcctctggggctcttccctcccttggactctctctcccagaatcctctctccccctcccaagctggggacagccccctggccactgagggcaggctttcagtctcttggaccctctgtcttccccagaagcggagcagttccagccgcgggctcccccacacaggagcctcctatgtcagggcctcccagcgcacctcagggcgcactggctgcgccccgtagtccagcagtgcggcgaaaaggacttcaggctcccagttgggggcgtcctggacggcctgcagcgcacagtccatgggcgtgtggcccgccccattggggacctcagcgcgggccccgtaacgcagcagcagctcggccaggcccccgcagccgctggcacaagcgttgtgcagcggcgtgtggcgcttgcgcccggccgcccgggcatcagctccagcctccaggagccggcgcgccgcagcctggtgtcgcctgcagctacctgggccctcggccccagcgcacgccgcgttcagcgcagtctcgccctggctggtgcgcaggcccacgtcggcgccatgctccaggtacagagccacatgttgctccaggccgcgcgccgccgccacgtgcaggggcgtctcctggctctcgcctgctgccaggttcaccgtcgctcctgcttccagcagcaacttggcgcacctggggacaagagagcaaggtcctgaggaaaatcctgaaggcttgggaccccttcagcttgctgtgacactcccttgcctttccacccctctcagcttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctccttttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcanacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcaccaaaaaaaaataa

SEQ ID NO: 428683 - DNA, 2068 bp, Homo sapiens
  misc_feature (1891)..(1891): n is a, c, g, or t
gcccgggctggcgccgctgggcagagccggtgcgacgtttccctttccagctttgttcttccggccctgctgtctgcctccccggctgattggattcgttactgctttgcaacgcgcacctaactccaggctggaatgcaatagcgtggtcttggctcactgcaacctccgcctcccgggttcaagcaattctcctgcctcagcctcctaagtagctgggactacaggggccctcctgctgctccctccatgaggctggtcctgaaggaataggcctgtggctcgtccctcctccccatctcggccctgaggcaaacataccttccacagctctgggagcaccgcctccacccaggtctcacaggatgggacacaaggataggcattaagcaggacttccagggcccgagggaagttggcgcagtgtttcagcatctaggggtcaaaagagggtcttgggcacatgcctcccccacccgagggcagacccaagtcttgcctcacccacatggccaatcctagcctaatctggggggctaaggtctgagtctctcttcccttttttgtgcctctgtctaccccaccctcaagtatgctccaaccttttggccccagttttcctctggggctcttccctcccttggactctctctcccagaatcctctctccccctcccaagctggggacagccccctggccactgagggcaggctttcagtctcttggaccctctgtcttccccagaagcggagcagttccagccgcgggctcccccacacaggagcctcctatgtcagggcctcccagcgcacctcagggcgcactggctgcgccccgtagtccagcagtgcggcgaaaaggacttcaggctcccagttgggggcgtcctggacggcctgcagcgcacagtccatgggcgtgtggcccgccccattggggacctcagcgcgggccccgtaacgcagcagcagctcggccaggcccccgcagccgctggcacaagcgttgtgcagcggcgtgtggcgcttgcgcccggccgcccgggcatcagctccagcctccaggagccggcgcgccgcagcctggtgtcgcctgcagctacctgggccctcggccccagcgcacgccgcgttcagcgcagtctcgccctggctggtgcgcaggcccacgtcggcgccatgctccaggtacagagccacatgttgctccaggccgcgcgccgccgccacgtgcaggggcgtctcctggctctcgcctgctgccaggttcaccgtcgctcctgcttccagcagcaacttggcgcacctggggacaagagagcaaggtcctgaggaaaatcctgaaggcttgggaccccttcagcttgctgtgacactcccttgcctttccacccctctcagcttgaggtcctacctggtgtcctccatgagaatcatacaagccccgctacagacaacagaattggaaggtcctgagagctaccagaagcatcttcagttttcatatgaaaaacttaagcccaggagtgatttgtgcagccaaggacacacagcaagttagtggctgcaccagaaatagtactcactgcctcagacagtccctcccacagtctactctgtctccaccccaaggtctggttctgaatcattcagttgtcagttgtctccttttttttttttttttggagacagggtctctctctgtggcccaggctgaagtgcagtggtgtgattacagctcatgtagcctggacctcccaagctcaagcaatcctcctgcctctgcctcccaagtagctgggaccacaggtgggcagcaccacacctggctaattttttaaatttttttttatagagacagggtcttaccatttgccccagctggtctcanacccctgggctcaagcaagcctcctgccttggcctcccaaagtgctgggattacaggtgtgagccaccacacccggccttatctcctaacattttgatagcacaaaattttgaaaacccacttctgtgtacgttatgaagcatagaaaattaaacagtatgcaccaaaaaaaaataa

SEQ ID NO: 428684 - DNA, 962 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 428685 - DNA, 1561 bp, Homo sapiens
  misc_feature (177)..(177): n is a, c, g, or t
  misc_feature (187)..(187): n is a, c, g, or t
  misc_feature (189)..(191): n is a, c, g, or t
  misc_feature (200)..(200): n is a, c, g, or t
  misc_feature (213)..(213): n is a, c, g, or t
  misc_feature (220)..(223): n is a, c, g, or t
  misc_feature (225)..(225): n is a, c, g, or t
  misc_feature (228)..(228): n is a, c, g, or t
  misc_feature (241)..(241): n is a, c, g, or t
  misc_feature (245)..(246): n is a, c, g, or t
  misc_feature (251)..(251): n is a, c, g, or t
  misc_feature (263)..(263): n is a, c, g, or t
  misc_feature (269)..(269): n is a, c, g, or t
  misc_feature (283)..(285): n is a, c, g, or t
  misc_feature (289)..(289): n is a, c, g, or t
  misc_feature (308)..(308): n is a, c, g, or t
  misc_feature (313)..(313): n is a, c, g, or t
  misc_feature (317)..(317): n is a, c, g, or t
  misc_feature (324)..(324): n is a, c, g, or t
  misc_feature (327)..(327): n is a, c, g, or t
  misc_feature (349)..(350): n is a, c, g, or t
  misc_feature (377)..(377): n is a, c, g, or t
  misc_feature (381)..(381): n is a, c, g, or t
  misc_feature (387)..(387): n is a, c, g, or t
  misc_feature (392)..(392): n is a, c, g, or t
tagagacagtgtctcactctgtctcccaggctagagtacagtgtgcaatcatagctcactgcagccttgaactcctggcctcaagcaatcctcccaccttggcttcccaatgtgctaggtttacaggcgtgaaaacattgtgttgtgtgtgtgtgtgtttttttttttttttttttnagacagagtntnnntcttgttgnccaggctggagtncaatggnnnnanctnggctcactgcaanctcnncctcncaggttcaagcnattctnctgcctcagcctcnnnagtngctgggattacaggcgccnaccancacncccggcnaantttttgtatttttagtagaganngggtttcaccatgttggccaggctggnctcnaactcntgacntcaggtgatctacccgattctacctcccaaagtgctgggattacaggcctgagccaccgcgcctggtcaaaaacatttaaaaaatgactgtccctgctcaaatactgcagtaggaaatgtaatttgacatatatcacttccagaaaaaaactttaaatctttctataaaatgaatttgatacatcatcagcatgaagtgaagttaaaatctcttacaaagtaaattcaggtatatcaacaatgagatccaaaagtatcggttcaagatcaaagactcatatgaggtaaaggcaaataaagcccctcatgctttcagacatttacttgttatccttaaaatgattattgttctaaggtgcaaatcttatcattcagtgacctatttgctatttggctgtttatctcctttaaataaaataccatacaggttataatgtacattttaaaatcaaatatgaaagtacacatatgtgaacaagacattaatttaaatatcaattatattcataatacagaagtctaagaatgctatttggtcatttcaattagatgctgatatatttggtcaagaaaacccacattcctatcagcctaaggcaaatagtaaatgcctctatttttattaagtggactataaacagtagacattattgtttgatactactggaatgctctcaattagaacgtacactgataacaaatatgtctttctaatctgggtgataacctcaatgattacatggaaatctacaagtaacagtctataacttaaagcagtagagcacctggtaattgtcatacagtgcctctctatgaatttagaacattctacttacattggcagtggagagaaaagaccccttcacactgagacttcctgtgcaccgcgcctgccgcctgcctcagcttaggacatggtacagtcttctttgcttttgcccttctcattccctcctctggtatcttctctgctttctggattgaagtgccctggctctcttcctggtgccgacaagtcattgttctctaggctattgctgtctaaagctttcctgacggtctgacttggatgttctgacatctcacatctttctgtcttcctcttctcaccctcctccctccccttagccatcacttctgggaagtaaagaacttgacttagtgccgga

SEQ ID NO: 428686 - DNA, 360 bp, Homo sapiens
gcggccgcctactactactactactgctcgaattcaagcttctaacgatgtacggggccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 428687 - DNA, 1528 bp, Homo sapiens
  misc_feature (1006)..(1006): n is a, c, g, or t
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggaaaaaaaaaaaaaaaaaaaaaaaaaaaaaaaaaaaaaaaaaaaanaaaaaaaaaaaaataaaataataaaagaaaggggggggagcgataataaataatcaccacgggggggcgcccatatatatagaggacacacaggtttttgtatagaaagggggggcacacaataggggcaggcataatataaagagacagagggagcaggggcagatgtatacagcagttgtgggagggagggaagaacaaaaggtgtgagtaagggggggagaaacctattgtgaagaaaaaagaaacacctaaaatatgtgagaggggggggggaaaaaaaaatatgtggtgaagagaacaaatctatctatgctgatgaggagacaatattaaaggagcgcttcgataggcggagtacaaatctatacaacatcgatttaggacgatgttacaatagtagtgtcgtgtgaaacacagccagtagtgtaattaatgtagtgtgcagcgagcagcagaaaaaaatattgtgtgacacaaagcgagggaattgatactatatagagacgaaaatatatagcg

SEQ ID NO: 428688 - DNA, 1503 bp, Homo sapiens
  misc_feature (981)..(981): n is a, c, g, or t
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggaaaaaaaaaaaaaaaaaaanaaaaaaaaaaaaataaaataataaaagaaaggggggggagcgataataaataatcaccacgggggggcgcccatatatatagaggacacacaggtttttgtatagaaagggggggcacacaataggggcaggcataatataaagagacagagggagcaggggcagatgtatacagcagttgtgggagggagggaagaacaaaaggtgtgagtaagggggggagaaacctattgtgaagaaaaaagaaacacctaaaatatgtgagaggggggggggaaaaaaaaatatgtggtgaagagaacaaatctatctatgctgatgaggagacaatattaaaggagcgcttcgataggcggagtacaaatctatacaacatcgatttaggacgatgttacaatagtagtgtcgtgtgaaacacagccagtagtgtaattaatgtagtgtgcagcgagcagcagaaaaaaatattgtgtgacacaaagcgagggaattgatactatatagagacgaaaatatatagcg

SEQ ID NO: 428689 - DNA, 1098 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtcggccggctggcggagctgggcgcggcgtcaggacgggccaccaggccgggctaggaaggtgtagtgggcctcagcgccgccaagggcggtcccggctcctgtaaccgttgcagtcttctgtcccttcacccaggtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 428690 - DNA, 1387 bp, Homo sapiens
  misc_feature (177)..(177): n is a, c, g, or t
  misc_feature (187)..(187): n is a, c, g, or t
  misc_feature (189)..(191): n is a, c, g, or t
  misc_feature (200)..(200): n is a, c, g, or t
  misc_feature (213)..(213): n is a, c, g, or t
  misc_feature (220)..(223): n is a, c, g, or t
  misc_feature (225)..(225): n is a, c, g, or t
  misc_feature (228)..(228): n is a, c, g, or t
  misc_feature (241)..(241): n is a, c, g, or t
  misc_feature (245)..(246): n is a, c, g, or t
  misc_feature (251)..(251): n is a, c, g, or t
  misc_feature (263)..(263): n is a, c, g, or t
  misc_feature (269)..(269): n is a, c, g, or t
  misc_feature (283)..(285): n is a, c, g, or t
  misc_feature (289)..(289): n is a, c, g, or t
  misc_feature (308)..(308): n is a, c, g, or t
  misc_feature (313)..(313): n is a, c, g, or t
  misc_feature (317)..(317): n is a, c, g, or t
  misc_feature (324)..(324): n is a, c, g, or t
  misc_feature (327)..(327): n is a, c, g, or t
  misc_feature (349)..(350): n is a, c, g, or t
  misc_feature (377)..(377): n is a, c, g, or t
  misc_feature (381)..(381): n is a, c, g, or t
  misc_feature (387)..(387): n is a, c, g, or t
  misc_feature (392)..(392): n is a, c, g, or t
tagagacagtgtctcactctgtctcccaggctagagtacagtgtgcaatcatagctcactgcagccttgaactcctggcctcaagcaatcctcccaccttggcttcccaatgtgctaggtttacaggcgtgaaaacattgtgttgtgtgtgtgtgtgtttttttttttttttttttnagacagagtntnnntcttgttgnccaggctggagtncaatggnnnnanctnggctcactgcaanctcnncctcncaggttcaagcnattctnctgcctcagcctcnnnagtngctgggattacaggcgccnaccancacncccggcnaantttttgtatttttagtagaganngggtttcaccatgttggccaggctggnctcnaactcntgacntcaggtgatctacccgattctacctcccaaagtgctgggattacaggcctgagccaccgcgcctggtcaaaaagggggtggttctaactttcatcttagggtagctgtgaaaatgaaaggagatgatacatccacagcacttggcacagggcttggcatacagtacatgctcaataaagggagctgttgccacctcttgtggtccctgctagggagggtgaggccttggcgtggaaagtgagaacagagctggtccctactgaggtggacactcttcttgctccctgggagggcaccgcgggcccaggggcaggcgctgagtcgcgtgtgctcctctctgattgctgcgcaggtcggccggctggcggagctgggcgcggcgtcaggacgggccaccaggccgggctaggaaggtgtagtgggcctcagcgccgccaagggcggtcccggctcctgtaaccgttgcagtcttctgtcccttcacccaggtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 428691 - DNA, 1664 bp, Homo sapiens
  misc_feature (1142)..(1142): n is a, c, g, or t
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtcggccggctggcggagctgggcgcggcgtcaggacgggccaccaggccgggctaggaaggtgtagtgggcctcagcgccgccaagggcggtcccggctcctgtaaccgttgcagtcttctgtcccttcacccaggtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggaaaaaaaaaaaaaaaaaaaaaaaaaaaaaaaaaaaaaaaaaaaanaaaaaaaaaaaaataaaataataaaagaaaggggggggagcgataataaataatcaccacgggggggcgcccatatatatagaggacacacaggtttttgtatagaaagggggggcacacaataggggcaggcataatataaagagacagagggagcaggggcagatgtatacagcagttgtgggagggagggaagaacaaaaggtgtgagtaagggggggagaaacctattgtgaagaaaaaagaaacacctaaaatatgtgagaggggggggggaaaaaaaaatatgtggtgaagagaacaaatctatctatgctgatgaggagacaatattaaaggagcgcttcgataggcggagtacaaatctatacaacatcgatttaggacgatgttacaatagtagtgtcgtgtgaaacacagccagtagtgtaattaatgtagtgtgcagcgagcagcagaaaaaaatattgtgtgacacaaagcgagggaattgatactatatagagacgaaaatatatagcg

SEQ ID NO: 428692 - DNA, 2159 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtaaggagccgtgggggtgggggcgggcgccacggcctgtcttggcagcgggagtcggggcccgtgaagggggatcgggaccgaagtccactttccgttctgaatgaggggcccgtccgggtcacccgctgagggtgtggaacttggattcccgacaactggggtctaggggcgggagtggggactccaggagcttgcccgtgggaacgatgggagctgaggaattgcctaggaatcagcactgtggagaatgaggaaacgtggatatcaggattcctgtttgagtggtacccggaccttgggtcatgggaccaccactaattgtgaggaaagggagtaaatttaagtctggactctgagctatatgtgttagactcagaccacgtactatgtaaggacaattacttatctaggacaattgcttgacttccttgtatcttattcgaccaacctccatttattgagcaatttacctcgtgctaggcattgtgctaggtgctggtatgcagtggtgagcttacagacaagatcgctgctttcctggagcctctgggtttgcctaccctcattttccctagttgcaaaaatagacatcatagcatctcttgatgtggtgagggttttatgaggtgatcctggaaaagtggttagcacaagagcctgtcttccaggaagggctaaactggtggttctcaattggggcagttccctccacccccacatttggcaaagtctggagacatttttggttgtcagaactgcgggagggggtgctagtgacatctatgggtagaggccagggatgctgctcaacttcctaccatgcgtggggcagcgccctcccacccccaaacaaagaataatccagctcaaaatgttattagtgccaggttgagaaactctggattaagtaaatagggcatatattgatttttggctctgagcttgccatgtctgtggtgttaagatcaagtccctgtagtgtggaggaaaaagtgttgagaataacaagactgggggctctagttctggatccagcatgtgattttgggcaaatgatctaacctctgcaagcctcagtttcttcatttgttaaaaatgggcgtgggttgggtgcagtggctcacacctgtaattccaacattttgggaggtcgaggtgggtggatcgcttaagcccaggagttggagaccagcctggacaatatggcaaaaatgcatctctacaaaaaaaaattaaaaaattagctgggcatggtgccacacatgcctggagctccagctacccaggaggctgagacaggaggatcgcttgagcccaggagattcaggctgcagtgagccatgattgcaccactgcgctctagcctggatgacagaacaagagagtatcttaaaaaaaaaatcggtgtgaaataatcccagcaggccaggctctgtggctcatccctgtaatcccagcactttgggaggccgaggcgggcagatcacctgaggtcaggggttcaagaccagcctggccaacgtggtgaaaccctgactctactaaaaatacaaaaattagccaggcatggtggtgcatacctgtaatcccagctactcgggaggctgaggcaggagaatcacttgaacctgggaggtggaggttgcagtgagctgagatcatgccactgcactccagcctcgacagtaagactctgtctcc

SEQ ID NO: 428693 - DNA, 971 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtaaggagccgtgggggtgggggcgggcgccacggcctgtcttggcagcgggagtcggggcccgtgaagggggatcgggaccgaagtccactttccgttctgaatgaggggcccgtccgggtcacccgctgagggtgtggaacttggattcccgacaactggggtctaggggcgggagtggggactccaggagcttgcccgtgggaacgatgggagctgaggaattgcctaggaatcagcactgtggagaatgaggaaacgtggatatcaggattcctgtttgagtggtacccggaccttgggtcatgggaccaccactaattgtgagactgtgtgtgctttggctacgcccctggtgctgacataccacatgatcctggaggcctgcagagaggacagtcccagaagcacctggtctccaagctcccacaccccaccgggcaaagccaaagcacacacagtctcacagttagcctctagaccaccagtctccggggcacatgtccccagacctag

SEQ ID NO: 428694 - DNA, 1095 bp, Homo sapiens
  misc_feature (177)..(177): n is a, c, g, or t
  misc_feature (187)..(187): n is a, c, g, or t
  misc_feature (189)..(191): n is a, c, g, or t
  misc_feature (200)..(200): n is a, c, g, or t
  misc_feature (213)..(213): n is a, c, g, or t
  misc_feature (220)..(223): n is a, c, g, or t
  misc_feature (225)..(225): n is a, c, g, or t
  misc_feature (228)..(228): n is a, c, g, or t
  misc_feature (241)..(241): n is a, c, g, or t
  misc_feature (245)..(246): n is a, c, g, or t
  misc_feature (251)..(251): n is a, c, g, or t
  misc_feature (263)..(263): n is a, c, g, or t
  misc_feature (269)..(269): n is a, c, g, or t
  misc_feature (283)..(285): n is a, c, g, or t
  misc_feature (289)..(289): n is a, c, g, or t
  misc_feature (308)..(308): n is a, c, g, or t
  misc_feature (313)..(313): n is a, c, g, or t
  misc_feature (317)..(317): n is a, c, g, or t
  misc_feature (324)..(324): n is a, c, g, or t
  misc_feature (327)..(327): n is a, c, g, or t
  misc_feature (349)..(350): n is a, c, g, or t
  misc_feature (377)..(377): n is a, c, g, or t
  misc_feature (381)..(381): n is a, c, g, or t
  misc_feature (387)..(387): n is a, c, g, or t
  misc_feature (392)..(392): n is a, c, g, or t
tagagacagtgtctcactctgtctcccaggctagagtacagtgtgcaatcatagctcactgcagccttgaactcctggcctcaagcaatcctcccaccttggcttcccaatgtgctaggtttacaggcgtgaaaacattgtgttgtgtgtgtgtgtgtttttttttttttttttttnagacagagtntnnntcttgttgnccaggctggagtncaatggnnnnanctnggctcactgcaanctcnncctcncaggttcaagcnattctnctgcctcagcctcnnnagtngctgggattacaggcgccnaccancacncccggcnaantttttgtatttttagtagaganngggtttcaccatgttggccaggctggnctcnaactcntgacntcaggtgatctacccgattctacctcccaaagtgctgggattacaggcctgagccaccgcgcctggtcaaaaagggggtggttctaactttcatcttagggtagctgtgaaaatgaaaggagatgatacatccacagcacttggcacagggcttggcatacagtacatgctcaataaagggagctgttgccacctcttgtggtccctgctagggagggtgaggccttggcgtggaaagtgagaacagagctggtccctactgaggtggacactcttcttgctccctgggagggcaccgcgggcccaggggcaggcgctgagtcgcgtgtgctcctctctgattgctgcgcaggtcggccggctggcggagctgggcgcggcgtcaggacgggccaccaggccgggctaggaaggtgtagtgggcctcagcgccgccaagggcggtcccggctcctgtaaccgttgcagtcttctgtcccttcacccaggtgggcaaacgcagaggcgggaacaaactagccctcaagacgggaatagtagccaagaagcagaagacggaggatgaggtgagccagcttggtgcagggggtccacccacattgcctttcccttccagcttttgcgcccagccttctccctccctgtctggtatccaggccttttatgagtgtgcctggcagggtaggagggctgtcaatgggtc

SEQ ID NO: 428695 - DNA, 806 bp, Homo sapiens
  misc_feature (177)..(177): n is a, c, g, or t
  misc_feature (187)..(187): n is a, c, g, or t
  misc_feature (189)..(191): n is a, c, g, or t
  misc_feature (200)..(200): n is a, c, g, or t
  misc_feature (213)..(213): n is a, c, g, or t
  misc_feature (220)..(223): n is a, c, g, or t
  misc_feature (225)..(225): n is a, c, g, or t
  misc_feature (228)..(228): n is a, c, g, or t
  misc_feature (241)..(241): n is a, c, g, or t
  misc_feature (245)..(246): n is a, c, g, or t
  misc_feature (251)..(251): n is a, c, g, or t
  misc_feature (263)..(263): n is a, c, g, or t
  misc_feature (269)..(269): n is a, c, g, or t
  misc_feature (283)..(285): n is a, c, g, or t
  misc_feature (289)..(289): n is a, c, g, or t
  misc_feature (308)..(308): n is a, c, g, or t
  misc_feature (313)..(313): n is a, c, g, or t
  misc_feature (317)..(317): n is a, c, g, or t
  misc_feature (324)..(324): n is a, c, g, or t
  misc_feature (327)..(327): n is a, c, g, or t
  misc_feature (349)..(350): n is a, c, g, or t
  misc_feature (377)..(377): n is a, c, g, or t
  misc_feature (381)..(381): n is a, c, g, or t
  misc_feature (387)..(387): n is a, c, g, or t
  misc_feature (392)..(392): n is a, c, g, or t
tagagacagtgtctcactctgtctcccaggctagagtacagtgtgcaatcatagctcactgcagccttgaactcctggcctcaagcaatcctcccaccttggcttcccaatgtgctaggtttacaggcgtgaaaacattgtgttgtgtgtgtgtgtgtttttttttttttttttttnagacagagtntnnntcttgttgnccaggctggagtncaatggnnnnanctnggctcactgcaanctcnncctcncaggttcaagcnattctnctgcctcagcctcnnnagtngctgggattacaggcgccnaccancacncccggcnaantttttgtatttttagtagaganngggtttcaccatgttggccaggctggnctcnaactcntgacntcaggtgatctacccgattctacctcccaaagtgctgggattacaggcctgagccaccgcgcctggtcaaaaagggggtggttctaactttcatcttagggtagctgtgaaaatgaaaggagatgatacatccacagcacttggcacagggcttggcatacagtacatgctcaataaagggagctgttgccacctcttgtggtccctgctagggagggtgaggccttggcgtggaaagtgagaacagagctggtccctactgaggtggacactcttcttgctccctgggagggcaccgcgggcccaggggcaggcgcctgtaatcccagctactcgggaggctgaggcaggagaatcacttgaacccaaggggcagaagctgcagttagtcaagtagcgtgagggtgccgagct

SEQ ID NO: 428696 - DNA, 1068 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggaaaaaaaaaaaaaaaaaaaaaaaaaaaacaaacccaaagaaaacaagagaaggccacaaaaacaacaaaaaaaaacagcacaggagggggggggccaaaaaaacaca

SEQ ID NO: 428697 - DNA, 1118 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggaaaaaaaaaaaaaaaaaaaaaaaaaaggggggggtaagaaatccccagagggccaggttacgttcccctttttgtacaagggcccaagggcgcgttataaaaaaggagggcgggttacacgcggggaaacgcgccttggtttggaaggccctctggg

SEQ ID NO: 428698 - DNA, 726 bp, Homo sapiens
tcgctattcatcggcacctcgctattcatcggcacctcgctattgatcggcacctcgctattcatcggcacctcgctattcatcggcacctcgctagtcatccgcacccgaggccctgtaattggaatgagtccactttaaatcctttaacgatcgctattcatcggcacccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 428699 - DNA, 1068 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaatctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggaaaaaaaaaaaaaaaaaaaaaaaaaaggggggggtaagaaatccccagagggccaggttacgttcccctttttgtacaagggcccaagggcgcgttataaaaaaggagggcgggttacacgcggggaaacgcgccttggtttggaaggccctctggg

SEQ ID NO: 428700 - DNA, 808 bp, Homo sapiens
ggcctgaccgctcttcccggcatgtattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtgggcaaacgcagaggcgggaacaaactagccctcaagacgggaatagtagccaagaagcagaagacggaggatgagataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccgga

SEQ ID NO: 428701 - DNA, 875 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcg

SEQ ID NO: 428702 - DNA, 1082 bp, Homo sapiens
ggggcttccccgtaaggggcgggcttcgagggtcgcgtttggaaggccttacgaggggcccggtggaagggcggtgaagggcgggctaatcgggaggcgctcaggccttgaaggcctgcgggaggtcgaaatggtcctggggaggtcgaggctgaggtctcactagtaccgcgggcctggaagcggcgggagttgaaagagcctgcggtgacctgtatggaagccctcgaagccaggccgaggtcctacaagacggagcccgagaggtgccggtcttaagctgactgtgaccacgttaaattaaggattcataggaaggaaggcggtgtcgaagccgggagttgcgcggagaaggagcgctcaacacagcctcagcggttcactacgcaagcgcgaccaacggcttcccgggaagcagccaaaaacgcttggccgcctaccacgtccgcgcgctggagggcggaagtgggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggctctgccttgatcttccttcctt

SEQ ID NO: 428703 - DNA, 700 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgcgcgtcctccaaaaaataaaaccttaaccgcg

SEQ ID NO: 428704 - DNA, 504 bp, Homo sapiens
cagagaagggtcacatggtgagcaagcaggtgaagctggaactctggacccacggtgatgtccccctctgtgtcctccttactgcaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggctctgccttgatcttccttcctt

SEQ ID NO: 428705 - DNA, 703 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggctctgccttgatcttccttcctt

SEQ ID NO: 428706 - DNA, 679 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcg

SEQ ID NO: 428707 - DNA, 878 bp, Homo sapiens
ggggcttccccgtaaggggcgggcttcgagggtcgcgtttggaaggccttacgaggggcccggtggaagggcggtgaagggcgggctaatcgggaggcgctcaggccttgaaggcctgcgggaggtcgaaatggtcctggggaggtcgaggctgaggtctcactagtaccgcgggcctggaagcggcgggagttgaaagagcctgcggtgacctgtatggaagccctcgaagccaggccgaggtcctacaagacggagcccgagaggtgccggtcttaagctgactgtgaccacgttaaattaaggattcataggaaggaaggcggtgtcgaagccgggagttgcgcggagaaggagcgctcaacacagcctcagcggttcactacgcaagcgcgaccaacggcttcccgggaagcagccaaaaacgcttggccgcctaccacgtccgcgcgctggagggcggaagtgggcttccactgcagccatgtcactcctcttgctggtggtctcagcccttcacatcctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcg

SEQ ID NO: 428708 - DNA, 917 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggtgaggggtgagggcggcgggactggtcttcaaaggggaaggtaaacccttcgtgtcctcatgggactgagaattgggaaccctcccccaacaaagttggagtgggcggggtccaggcctgagtggctgagtgcctagggctaatgcatgtcccgcctgtctggatgtacctacctcttgttttttttgtttttgttttttgagaccgagttttccttccagcctgggcaacagagcaagattctgtctcaaaaaaaaaaaaaaaaaaaaagaatagagaaaaatctcccaagattctgagaagacaagagtatttttccaaagctctaaggagatggggctggtgctctgaatggatgcctgggaccatttcatccaaattccaaggggatggggctgaaaccacttaaggttctaaaggggtggggccaggtg

SEQ ID NO: 428709 - DNA, 899 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggctctgccttgatcttccttcctt

SEQ ID NO: 428710 - DNA, 940 bp, Homo sapiens
gtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggtgaggggtgagggcggcgggactggtcttcaaaggggaaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggctctgccttgatcttccttcctt

SEQ ID NO: 428711 - DNA, 558 bp, Homo sapiens
tgctgggtgaaggagtgagcataattggactgtgagtggaaccctatactgagaatgggtaaagcagcagtaagaaagaaaatccttactaacatgatgttacactgtccctactggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcggctctgccttgatcttccttcctt

SEQ ID NO: 428712 - DNA, 2072 bp, Homo sapiens
ttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggattacacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428713 - DNA, 2770 bp, Homo sapiens
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428714 - DNA, 2770 bp, Homo sapiens
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgacaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428715 - DNA, 2381 bp, Homo sapiens
cgagattgcagcgctggcgccctgggttcccgggtgcttcctgcctgaccagtccccatgtctgggcggtgcagtcgcgcgtggcccgccagcacgtcagtatgtcgggtggcaacaggggaccaccactgacaggtctctcccgccctgtccccgcagcgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428716 - DNA, 1225 bp, Homo sapiens
ccggccgactctctctctgtggggggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428717 - DNA, 331 bp, Homo sapiens
aagaccaaatacttaagcacggaatgtatttctgtttatgatatggaattcaatacaccccttcagtggtataaagacattcctggatttctttaggatagggtcagagttggtttactatctggccttcagtttttaaaaggggcgattctttgatatagcaatagcgtcaattttttttttcttttacctttacaggtgagaaaccttaccactgtgactgggacggctgtggatggaaattcgcccgctcagatgaactgaccaggcactaccgtaaacacacggggcaccgcccgttccagtgccaaaaatgcgaccgagcattttc

SEQ ID NO: 428718 - DNA, 735 bp, Homo sapiens
ccacttcgggacacacgggatgatgctcaccccaccttcttcacccctagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtagggggacaaactgcagaagggaggggggttagcttccagccccataggctaccagtggacactcctcagtgcctccttgacttcccaggttagcttccagccccataggctaccagtggacactcctcagtgcctccttggcttcccagggcagtctatcgccttgatctccgggatcactggagagaacagcaaaccggcgcctacttttctgcccaggagccttttgcttgatggatggtatctgtgtttgaatgtgcaattttgttaggcttttaaaaggcaggagattccccgcggtctgtgggcctctcctagcttggcattataatcaagaaattatactttgctatgcaaaagcatgatggcttttttaaaaaaatcgttttttaatgttcccttcccaggttcaccctccctttttgttattttgaattctggtcgtaacaattcggtcttacttttttattttttattttttgttcgttttgatttacatttttattttttttccccc

SEQ ID NO: 428719 - DNA, 2824 bp, Homo sapiens
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428720 - DNA, 1081 bp, Homo sapiens
  misc_feature (1069)..(1069): n is a, c, g, or t
  misc_feature (1076)..(1076): n is a, c, g, or t
  misc_feature (1081)..(1081): n is a, c, g, or t
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtcgtccctcgcggtcttaactgcgctacatagctcgcgtctgcacttggcgatgacggctcgcgnacgacgngggtn

SEQ ID NO: 428721 - DNA, 2693 bp, Homo sapiens
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaattta

SEQ ID NO: 428722 - DNA, 2941 bp, Homo sapiens
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggtaggtgaggcgcgcggcgctgggagcagggaggggtgaggaccggtgggacgcgccggaacgacggccgaaagccgcccctgactctcctgtctccgctccctgccttgctcgcaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428723 - DNA, 1184 bp, Homo sapiens
cgctcccacccgcccgtggcccgcgcccatggccgcgcgcgctccacacaactcaccggagtccgcgccctgcgccgccgaccagttcgcagctccgcgccacggcagccagtctcacctggcggcaccgcccgcccaccgccccggccacagcccctgcgcccacggcagcaatcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaattt

SEQ ID NO: 428724 - DNA, 1337 bp, Homo sapiens
aaaataaataaataagtaacttgcaacagtcgggttcttattgctcagtggacatttatcagcgactactaccatgggccaaggtcatgtggaattattgaaaacacagtggactgaatttaatggcattagagattatcacaagagaggaagtatgtgcaacacccttttttcagatgccattctggaatataaactttatgaagctttaaagttcatcatgctgtatcaagtcactgaagtttatgaacaaatgaagactaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgccactaccacattccagtcttttaagtccgctgggggccgaacagcagtgctcaccagtgacggtggtcacagttgcaataaagtctctctctgaaaccaaagctagcatttcagcatggaaggaattaggaccttttcttcaggattacaggtacactggatgcagccatgcatggatggtttttctttatttttcagtgatttcctctgaagcagctgcactgatacatttgggagttggtggcttgactttgtccataaggggcgtggccacttcacatgatggcgggcctttaagagcacaaagaagtttaatatggacaacaacaggaaaaagcaagaagaaaacaagtagggaaaaacagctaacctggagagaaagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcgtaatagttttatttagattttttaaaattctgtagattaaagcaaatgacagttattgaactatcacaaaactattaaactgtggtacatttaatgtgtaa

SEQ ID NO: 428725 - DNA, 2854 bp, Homo sapiens
gcggccgtcgcgtctgacagaccactgcagaccacgggccgaggcccagcgcccgtccgcagcgcggccggcatggcggcgacaaggagccccacgcgggcaagggagcgggagcggtctggcgctcccgccgcaggaagtgaccaagttcactcctggatgctagctacaagccaagccttagacactgtctggagaatggcaaaaggctttgtgatgttggcagtttcatttctggtggctgccatctgctacttccggaggctacatttatattcagggcacaagctgaaatggtggattggatatctgcagagaaaattcaaaaggaacctcagtgtggaggcagaggttgatttactcagttattgtgcaagagaatggaaaggagagacaccccgtaacaagctgatgaggaaggcttatgaggagctattttggcggcatcacattaaatgtgttcgacaagtaaggagagataactatgatgctctcagatcagtgttatttcagatattcagccagggcatctcttttccatcatggatgaaagaaaaggacattgttaagcttcctgaaaaactgctgttttcacaaggttgtaattggattcagcagtacagttttggtcctgagaagtatacaggctcgaatgtgtttggaaaactacggaaatatgtggaattattgaaaacacagtggactgaatttaatggcattagagattatcacaagagaggaagtatgtgcaacacccttttttcagatgccattctggaatataaactttatgaagctttaaagttcatcatgctgtatcaagtcactgaagtttatgaacaaatgaagactaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgccactaccacattccagtcttttaagtccgctgggggccgaacagcagtgctcaccagtgacggtggtcacagttgcaataaagtctctctctgaaaccaaagctagcatttcagcatggaaggaattaggaccttttcttcaggattacaggtacactggatgcagccatgcatggatggtttttctttatttttcagtgatttcctctgaagcagctgcactgatacatttgggagttggtggcttgactttgtccataaggggcgtggccacttcacatgatggcgggcctttaagagcacaaagaagtttaatatggacaacaacaggaaaaagcaagaagaaaacaagtagggaaaaacagctaacctggagagaaagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcgtaatagttttatttagattttttaaaattctgtagattaaagcaaatgacagttattgaactatcacaaaactattaaactgtggtacatttaatgtgtaatttaatgtgtggaatctcattatggtaggcagaataatgccctatgctccccaaagatgtctgtgtctgaatcctcagagccgtaaagggctaaatgggttaaatgggaaaggagaattaaggttgcaggtggaactgagatgctaatccaatgatgctgaaatagggagatttttctagattctccaggtggacgcagtgtaatcagaatggttcttaaaagtggaagagggaattggaagagtgtcagagtcagaggggaatgtgaaatatggaagaacggttagagagagatgcaccattgctggctttgaagatggaggaaggggccataagccagggagttgcaggcagcctgtagaattgagactggaaaggaaacagaaacttccccatagcctccagaaggaacgcagccctgccaacaccttgattttagcccagtgaagcctgtgttggacctctaatctgcagaactgtaagataatagatttgtgtttaagccactaagtttgtggtaatgtgttgtagcaacagaaaactagtattctcaggctagtttttggtcgtctttattttggaaatacttttctagtttaatttgatagttttttttttggaggtactttgctagtctgttttgagtttcagtacataagaataatttttaaaatcttgctaattatatattacttcaaagtcacaaatccctttctaagaatgacttacttcacgagatatttagcactatcattttcccagatgttcatattatttctgcaataaattaaaagggagtgtgtcaaatgctgtcatgtctgaaattagcattcatattcttttgcaatggggatgatcagtcgtgtgtactacatgaaccatgtctgatggtagcttgttcccactgtcattttgttttctggttga

SEQ ID NO: 428726 - DNA, 1927 bp, Homo sapiens
gcggccgtcgcgtctgacagaccactgcagaccacgggccgaggcccagcgcccgtccgcagcgcggccggcatggcggcgacaaggagccccacgcgggcaagggagcgggagcggtctggcgctcccgccgcaggaagtgaccaagttcactcctggatgctagctacaagccaagccttagacactgtctggagaatggcaaaaggctttgtgatgttggcagtttcatttctggtggctgccatctgctacttccggaggctacatttatattcagggcacaagctgaaatggtggattggatatctgcagagaaaattcaaaaggaacctcagtgtggaggcagaggttgatttactcagttattgtgcaagagaatggaaaggagagacaccccgtaacaagctgatgaggaaggcttatgaggagctattttggcggcatcacattaaatgtgttcgacaagtaaggagagataactatgatgctctcagatcagtgttatttcagatattcagccagggcatctcttttccatcatggatgaaagaaaaggacattgttaagcttcctgaaaaactgctgttttcacaaggttgtaattggattcagcagtacagttttggtcctgagaagtatacaggctcgaatgtgtttggaaaactacggaaatatgtggaattattgaaaacacagtggactgaatttaatggcattagagattatcacaagagaggaagtatgtgcaacacccttttttcagatgccattctggaatataaactttatgaagctttaaagttcatcatgctgtatcaagtcactgaagtttatgaacaaatgaagactaaaaaggtcattcccagtctttttagactcctgttttccagggagacatcctctgatcctttgagcttcatgatgaatcacctgaattctgtaggcgacacatgtggactagagcagattgatatgtttatacttggatactcccttgaagtaaagataaaagtgttcagactgttcaagtttaactccagagactttgaagtctgctacccagaggagcctctcagggactggccggagatctccctgctgaccgagaacgaccgccactaccacattccagtcttttaagtccgctgggggccgaacagcagtgctcaccagtgacggtggtcacagttgcaataaagtctctctctgaaaccaaagctagcatttcagcatggaaggaattaggaccttttcttcaggattacaggtacactggatgcagccatgcatggatggtttttctttatttttcagtgatttcctctgaagcagctgcactgatacatttgggagttggtggcttgactttgtccataaggggcgtggccacttcacatgatggcgggcctttaagagcacaaagaagtttaatatggacaacaacaggaaaaagcaagaagaaaacaagtagggaaaaacagctaacctggagagaaagaatttctttaacctttatgttcttcattaaaaatcttatcttggactgatttgagggatttttagaaacatggccttattttatataagcattaccttcccaggaatctttgttgtatattaatttttgataaccatttgattaactttaaaattaagtatatgtgtgtatatatacatatgtatgtttatatacacacatgtatctgtatagttttatatatacatatatacacatagacatacagagaaccactactttgtaatagtgtacagtttgttttatatctctttactttttttgttactattttatctggccagcgtaatagttttatttagattttttaaaattctgtagattaaagcaaatgacagttattgaactatcacaaaactattaaactgtggtacatttaatgtgtaa

SEQ ID NO: 428727 - DNA, 675 bp, Homo sapiens
gacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttcta

SEQ ID NO: 428728 - DNA, 837 bp, Homo sapiens
gacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttcta

SEQ ID NO: 428729 - DNA, 484 bp, Homo sapiens
cccccggactgcaggaattcggcacgagatttatttccctttcttaaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttcta

SEQ ID NO: 428730 - DNA, 514 bp, Homo sapiens
  misc_feature (492)..(492): n is a, c, g, or t
cccccggactgcaggaattcggcacgagatttatttccctttcttaaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctaaaaaaaanaaacaactcgaggaggggccgc

SEQ ID NO: 428731 - DNA, 1300 bp, Homo sapiens
gacgtggcgggttgctttccaaaatggcgcgggtgctgaaggctgcagccgcgaatgccgtaggtgaataccgggcaccggcgaccttcgccatgggacagggagcgtgggaacggcggtcgggggcggaggaggcctcggcgtggccaaagcaccttgatctaatgtcctcccccgggggcgcgttccacagcagctgctgtcacttaggcagagggtgccttccagaagcgccaccgcttagtagcggggattgccttgtgcatgagtcccatttccatccgagagctgtgcgccttgggctctgcaccttccagtatgtgggcgggagagtcgagggaacttgcccggcaggtcaggcagggcagggacagaagtaaatagaagcggatcggtaagttattttaccgcgcaccaataaagagactggggagaaaccagaaaggagagcacgttccgtaaaaacaacaactactagtcggccgaactccaagcgtgaccagctttctgttgggaacactcaaagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttcta

SEQ ID NO: 428732 - DNA, 867 bp, Homo sapiens
  misc_feature (845)..(845): n is a, c, g, or t
gacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctaaaaaaaanaaacaactcgaggaggggccgc

SEQ ID NO: 428733 - DNA, 869 bp, Homo sapiens
gacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctaccaaaaaaaacaaaacaaacaaaaaaccaaaa

SEQ ID NO: 428734 - DNA, 1332 bp, Homo sapiens
gacgtggcgggttgctttccaaaatggcgcgggtgctgaaggctgcagccgcgaatgccgtaggtgaataccgggcaccggcgaccttcgccatgggacagggagcgtgggaacggcggtcgggggcggaggaggcctcggcgtggccaaagcaccttgatctaatgtcctcccccgggggcgcgttccacagcagctgctgtcacttaggcagagggtgccttccagaagcgccaccgcttagtagcggggattgccttgtgcatgagtcccatttccatccgagagctgtgcgccttgggctctgcaccttccagtatgtgggcgggagagtcgagggaacttgcccggcaggtcaggcagggcagggacagaagtaaatagaagcggatcggtaagttattttaccgcgcaccaataaagagactggggagaaaccagaaaggagagcacgttccgtaaaaacaacaactactagtcggccgaactccaagcgtgaccagctttctgttgggaacactcaaagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataaatacataaatatgtatattatttagattaacaaacatatttgttaatttgaatttgaagaaaatcttgattactaattacttagggaacattattaaaatcatatagaaataaattattcctcttctaccaaaaaaaacaaaacaaacaaaaaaccaaaa

SEQ ID NO: 428735 - DNA, 781 bp, Homo sapiens
gacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggaacctgggtcgactcaaccatgtagccatagcagtgccagatttggaaaaggctgcagcattttataagaatattctgggggcccaggtaagtgaagcggtccctcttcctgaacatggagtatctgttgtttttgtcaacctgggaaataccaagatggaactgcttcatccattgggacgtgacagtccaattgcaggttttctgcagaaaaacaaggctggaggaatgcatcacatctgcatcgaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacaggtatattatttagattaacaaacatatttgttaatttgaatttgaagaaaatcttgattactaattacttagggaacattattaaaatcatatagaaataaattattcctcttcta

SEQ ID NO: 428736 - DNA, 417 bp, Homo sapiens
cagaggagatagactgcatgagctctcaaagttttttctaagtcttatgatactataagttggtatttttatgatctcaaatgtgttcaatttatttccctttcttaaggtggataatattaatgcagctgtgatggatttgaaaaaaaagaagatccgcagtctaagtgaagaggtcaaaataggagcacatggaaaaccagtgatttttctccatcctaaagactgtggtggagtccttgtggaactggagcaagcttgatttatatttgcaagcaactaaattaattgacctgaaaaagcctatcaaatactatcaaaatgtactatgacattgagtccttcactgcttccatcatgtaaaagttcacagttaaagactgaattacagaaagattaaaatatatacatatataa

SEQ ID NO: 428737 - DNA, 3463 bp, Homo sapiens
gtcaaaccagaaccgagacacttaaaaagtacttcattttttgaatggaaaatattggagaaaagtatgggagatgcaggtagcatgtgagtaaatactacggtctagccttcgagcatcccaaattccgggggtaacttgacagtgctgtgctctcctttgtcatttatatctggcttaggaatggaatagtaataacaagatgccagtgatttggaatagtttgttatagaacattcagtgcaaaatagtgaaaatgtttggtcttcagaagtgctgtagttgttggtcattgccttaaagcagtctgcttgacgctaggagcactgaagcagtccagctccatcaagagcactgttgaagggagaagaacccttgttcaggaagccttagaaagggatccttaaaatagtactctacgcagacaagtgaaaattcttttaaactggatattactcaacatgttttcagatgtttccactacattgaggcaaactttttaaaagtggaatgcaaatagcattttactttagtatttctgcttttttctttctgtttctttggtaattgaaagtttgttgatgaatatttgtgtaaaacgcattcaagtctataacctttccaattacctgtggcccttagtcccacaggagtccctgttggaagggggtaaacactggatattaatgttgctgagtgagtctttctagccaggacaagctgattggaatttttgaatggtagagaagaaacagcacaaaggcacttgccattttaagtgtttggagaaagagaaccttttaagtttggattgggtgagctttcttctaaaaggagcttctgaagtaattgcaaaggaatagaatcgactatttttatagtatatttaatatatttgtatataactataataggaaccctctacatgcctcccacttttctaatttacttccccttttgccatagcactagtatagcctcatccgcatgggtaatgtgcctattgtcagcctaccaaaagatagtgctgctgctttatgagacaggtgagaagacccaactctcatgcctggggatcctttacggaaggaatagcacacacttttaaaacaacataccacagtctaaaagcatcattttgaaatgtaacaagcactttattgcaattactcatttgataaagtttattcttaggcgttaaccatttctaaaggatccccaaatcatcacttacttaggtgaaattatataaaatgacacatttctgagaaatgtttaggtccagtgaaccgtagttggtttatgggagtgatttcaagatagccaaatgaactttgatttttgttttgaatgtggtggagtcaagagattgtagatgcctagtttgatttaaacactattgtaaacctatcttgcctattgtgtggacaccaaaagagaccaatgagcctgtttatttttcagaggtctaggaaaattgcatccgtgtgagtagatgtacagaactaatctaaaagtgattgctagtaacattttagaatataataatttcaagaattattctgagtgttttaaatgtgccctgaaatgttggcatgtcatttcagcatttccatttgaattgctcttgtaatatttttgcacaaaaaggactgagaaaaagaatactttggttaaaggaaaaaaatagtataatttggtctttaattttaatgtctcctgtggaaacactggggatgaattttgttggcacagttattcaggatatttaaaacagtgttgaacagttcacaagaaattaagcaaacttggattttaaaaattaaaatactttctttccatgtgactgttttgcatagttttttccccctatgtcataacactacattccttgtttttcttaaataaaatactctgcaggttttgttgtgagtgtttataacagtattttgtaagctgcctgggtttcctcagggaaacattatttagtggaataggatatagtttatggagagacaactaagtgaaattccatcaccaccaccagcaaacactgaggtgctgcattaagtgacaatcaaactagtaagtatttatgaaagaatttagaaaggggttcaaagaagcaattgcttttaaagcagttctctggggttcttgaataaaaatggctaaatgtatttatttatattttaaaatacctgtgtgttctgttttctcatcaaagtgatttcggtgtcatgtatttaatgtgtggtttgttttgttttgcaccatattcttcttagggaactggctctgatttggggtgcagtcaccaactctcatgataatctttacggacagtctgaatctactttacttcaggacggcagtggaggggccaactccagatgcccctgcacttccctcctcaagtcatctaagaaagaattttagaaataactcctttcaaatctgattcatacagttccaacctttttctagtttcacttgctgccttctttggttttatgggcactttttgtgtgattacttccccaacacagtcaaaggccagtatgacagaaccaatggcacatgatgcctctattttgcccatttggggaaatgttagtaaaagaaatagcatcttttaatggctgtcattatcatatccatattaaaatccatttaaagttcttaaatttggcggaataatgtatacaggctgtaaacttctacaaaaaatgtttgctgtctttaatatggtgtcaagttacttggtcctttgaaaacaaaacaaaacttccatacacagcactgcccagtaaagcagtgttggaatattggaaacctagacattcgaggatccttcttgctcacaagcattggaacagaatcctccactttaggactcagagaagctatggagtcccacaggctaggtatagcacacaacttagagaacggtagttaaagcacgtcaaccacaattgaatttaatgatctaaaaaatatttcttaactctgagggttaaactgaagatacgttttcaaataaaagcttttaaatttcttaggaaacaaactgtgacatcgcttttaaaaatgacattcaaatgtttataatgtgtgtttttgagttggcttggactagtgcaagttcactgctggcaatggttatgccagtagttaagttaaaataagttgttaccttcagattgatgtcttgtataaccagacaatcatcttcaagcaaaaaaattggccaggaaatgtctttttaaaaaaaaaaaaaaaaaaaaagatgtgtcagccagaacagttaccattcagaccatactggaatgattttgaaatctttactatggtttaagttggggaaggcctcagtatggcattttcatattcactctatgtaaagattgaagcccaaagatgagttaaattcagtgctgtattgaaaccagtcagtgcaaaa

SEQ ID NO: 428738 - DNA, 783 bp, Homo sapiens
ctcaagtgatccacccgcctcggcctcccagagtgctgggattacagatgtgagccgccgcgcctagccagttcactttcttaatgatgtcttttgatgatggaaagtcctaactgtaatggagttcgctttcccaatgctgactcttatggttagtgcctttggagtttaagaagcatttcctgctccaagatcatgaagatactctcctctgtcttatggaagcttggttatttttgccttcacatttagatctttcatctaccccagatgaatgctacctgcttttaccctgagaactgtgtttggggggaccatgtacccctgaggggctcttcggggcacacagctcttctcttaccatgggcctcagaggcaggcccggagtgagtttcagactttgtgagtgaagcccttcaaaacacgaaatattcccagaaacccagtaagtgcagcagacctactctaactgggggcagtgggaggacgcccacatcctgccccctcagcccctctctgacaccccagggtggccctgaatccaggggccctaggagcccagctttagaatcaccgcgctgggtactcgatggagcttgtctctgatgcagaacactcctagcattctctctcagggctcttttcatttgaatgacctagaggattgagctcatgtaggcactgaaggcttccacctctcccatacccgcaaggccgatctgccttcagctcccagcaagtgtggggcagcgcgggccacagagtagggtgcagggatggggc

SEQ ID NO: 428739 - DNA, 2809 bp, Homo sapiens
  misc_feature (1)..(2): n is a, c, g, or t
  misc_feature (4)..(4): n is a, c, g, or t
  misc_feature (6)..(7): n is a, c, g, or t
nncncnnggcttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagctttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacggacacacttaggagagaagtttatgtgtagggactgtgggaaggctttagcaataatcaacatttaccagacatccaatgacagcctcaggggaaagcacccttgtctggggagtgttggggagcatcagtaaaagaatggacactcaggcacagagtggccctcaggaaggaggtctttgtttgtaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccccagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttaggaggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatcaaaaaaaga

SEQ ID NO: 428740 - DNA, 1843 bp, Homo sapiens
  misc_feature (1)..(2): n is a, c, g, or t
  misc_feature (4)..(4): n is a, c, g, or t
  misc_feature (6)..(7): n is a, c, g, or t
nncncnnggcttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagctttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacggacacacttaggagagaagtttatgtgtagggactgtgggaaggctttagcaataatcaacatttaccagacatccaatgacagcctcaggggacacccttgtacctgggtcagatctgccgggatcctctagaacgccgcacacc

SEQ ID NO: 428741 - DNA, 2755 bp, Homo sapiens
  misc_feature (1)..(2): n is a, c, g, or t
  misc_feature (4)..(4): n is a, c, g, or t
  misc_feature (6)..(7): n is a, c, g, or t
nncncnnggcttctggccttctcctgtcagcagttcctcagtcaacatgtacttcagatcttcctgggcttatgtgcagaaaatcacttccatccagggaattctagcccagggcattggaaacagcaggggcagcagtattcccatgtaagctgttggtttgaaaatgcagaaggtcaggagagaggaggtggctccaaaccctggtctgcaaggacagaggagagagaaacctcaagggcattccccagcccactccaaagacagtcagcaagtcctagaaaaggcaacatggtggtagaaacagagcccagctcagcccaaagaccaaaccctgtgcagctagacaaaggcttgaaggaattagaaaccttgagatttggagcaatcaactgtagagagtatgaaccggaccataacctggaatcaaactttattacaaacccgaggaccctcttagggaagaagccctacatttgcagtgattgtgggcgaagctttaaagatagatcaaccctcatcagacaccatcgtatacactcgatggagaagccttatgtgtgcagtgagtgcgggcgaggttttagccagaagtccaacctcagcagacaccagagaacacattcagaagagaagccttatttgtgcagggagtgtgggcaaagctttagaagtaagtccatcctcaatagacatcagtggactcactcagaggagaagccctatgtttgcagcgagtgtgggcgaggctttagcgagaagtcatccttcatcagacaccagaggacacactccggtgagaaaccctatgtgtgcctggagtgtggacgaagctttgtgataagtcaaccctcagaaaacaccagaggatacactcaggggagaagccttatgtttgcagggagtgtgggcgaggctttagccagaactcagatctcatcaaacaccagaggacacacttggatgagaagccttatgtttgcagggagtgtgggcgaggcttttgtgacaagtcaaccctcatcatacacgagcggacgcactctggagagaagccttatgtgtgtggtgagtgtggccgaggctttagtcggaaatcactcctccttgtccaccagaggacacactcaggggagaagcattatgtctgcagggagtgtaggcgaggttttagccagaagtcaaatctcatcagacaccagaggacgcactcaaatgagaagccttatatttgcagggaatgtgggcgaggcttttgtgacaagtcaaccctcattgtacatgagaggacacactcaggagagaagccttacgtgtgcagtgagtgtggccgaggctttagccggaaatcactcctccttgtccaccagaggacacactcaggggagaagcattatgtttgtagggagtgtgggcgaggctttagtcataagtcaaatctcatcagacaccagaggacacactgacgggagaaacctgtgtatgcaggggtcatgaacaagacctgagtgaccagtcaagcctcatgttaccccagagagacacatggggagtagaccctgtgtacacagattgtgagtgaagttccagagatgtgtcagcccttatcaggcatgggagggacacgttcaggagaggagccttatgagtatagagtacgggcaactgtagccatcagtcagccttgagcatgcacggacacacttaggagagaagtttatgtgtagggactgtgggaaggctttagcaataatcaacatttaccagacatccaatgacagcctcaggggaaagcacccttgtctggggagtgttggggagcatcagttaggatgtatgggcaaagcttttgtgatcacacaccacagggagaatctgcatgtggggacactgtggagctctgcccagatgaccttttcaggggtaacaccccagctgcttgagagaacagtgttgctgctggcagagatgcattccagagatgcactccgctctggaactcactctcagccacagggagctgcatgcaccacaggggcaatgcacctttgcaggggtaccttctggccccaacccttgactcaacggggacaactccagaaggtcattccagatccagagatccccatcgaactgaaggatcactgggttgcagacacattgcaggtcagcttcttcctctgcccagtcctgccctcactccccagtgaatcctcaattttctgtctcgttgtctgtccagataattgattctaagacatgttaggtatataaggagtgtagataaggcttcagccatgagtcaccccccagtaagccccagagtatattgaatagaaattctgcatgtgtggggagaatggacaaggacttaggaaaaagtcctcatcaaagaacagcttttttgggacaagctttacatgggtggggagggaaaatgtgaaacacattagcaataagttaaacctcatcttgtactaaaggaggacacactcagggagaagacctctgtgggcagggcttgtgggtggagcttcatcccgatgtcactcctcaactgacttaggaggacagtcttgctaccccaagtcactacctcactcacctctgagggattttcaggaaatgtcttgactcccccatgtactctgtatgtgagcgaagatggcagtaactgttaaataagcattcttttctacttcttggaatcagatgaaataaaaaagcaggctttatttaagtaatcaaaaaaaga

SEQ ID NO: 428742 - DNA, 642 bp, Homo sapiens
  misc_feature (19)..(19): n is a, c, g, or t
ggcgggatctaaggcgacnctagccctgctcccagttcaggaagcctctacagctccagagcctagcagggtagtggcccaaggctttgggtcctggctcttgaacaaaaaccttccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgt

SEQ ID NO: 428743 - DNA, 2751 bp, Homo sapiens
ttgcaggcgagttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacaggttctgacaggtcagggcaaggcgggggcccaatgagagtggcagactgccttgacacagccccgtgtttccccagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacagtacggtggcaccggtgggcagaggcctaggctaggctggggggaaggggctggttgtggccatggtgccctccataccgaggcgtgtggtgcctggctgtgccttgccgctgtggaggtgagtctgcatgccaatccccacagtgttggggtcccctaggcagctcagatcccacctccttcctggggccacctactgaccaccctccctgcctgccacagacggggtggagtcggagctgctgcacacctacagcaaggtggacccgtttgacgtcctgatcctgtgtgtgcgcgtggccgtgctgacagcagtcacgctcacagtgcccatcgttctgttcccggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgccacatctgccccattcctcatcttcatcttccctgccatcttctacttccgaatcatgcccacggagaaggagcctgcaagatccacccccaaaatcctggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgt

SEQ ID NO: 428744 - DNA, 2440 bp, Homo sapiens
gtccagacacccaggtcacagaccctccacccccaggcctcccagagcccctcaccctctgccagccacggtagccccccagtggcctctttttcttccatcttcccatgtgtccccaggttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacaggttctgacaggtcagggcaaggcgggggcccaatgagagtggcagactgccttgacacagccccgtgtttccccagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacagtacggtggcaccggtgggcagaggcctaggctaggctggggggaaggggctggttgtggccatggtgccctccataccgaggcgtgtggtgcctggctgtgccttgccgctgtggaggtgagtctgcatgccaatccccacagtgttggggtcccctaggcagctcagatcccacctccttcctggggccacctactgaccaccctccctgcctgccacagacggggtggagtcggagctgctgcacacctacagcaaggtggacccgtttgacgtcctgatcctgtgtgtgcgcgtggccgtgctgacagcagtcacgctcacagtgcccatcgttctgttcccggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgccacatctgccccattcctcatcttcatcttccctgccatcttctacttccgaatcatgcccacggagaaggagcctgcaagatccacccccaaaatcctggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgt

SEQ ID NO: 428745 - DNA, 995 bp, Homo sapiens
  misc_feature (982)..(982): n is a, c, g, or t
  misc_feature (984)..(985): n is a, c, g, or t
ttgcaggcgagttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagcttgggctacagaatganannctgtttcaca

SEQ ID NO: 428746 - DNA, 2453 bp, Homo sapiens
ttgcaggcgagttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacaacggggtggagtcggagctgctgcacacctacagcaaggtggacccgtttgacgtcctgatcctgtgtgtgcgcgtggccgtgctgacagcagtcacgctcacagtgcccatcgttctgttcccggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgccacatctgccccattcctcatcttcatcttccctgccatcttctacttccgaatcatgcccacggagaaggagcctgcaagatccacccccaaaatcctggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgt

SEQ ID NO: 428747 - DNA, 2529 bp, Homo sapiens
ttgcaggcgagttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacaggttctgacaggtcagggcaaggcgggggcccaatgagagtggcagactgccttgacacagccccgtgtttccccagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacaacggggtggagtcggagctgctgcacacctacagcaaggtggacccgtttgacgtcctgatcctgtgtgtgcgcgtggccgtgctgacagcagtcacgctcacagtgcccatcgttctgttcccggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgccacatctgccccattcctcatcttcatcttccctgccatcttctacttccgaatcatgcccacggagaaggagcctgcaagatccacccccaaaatcctggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgt

SEQ ID NO: 428748 - DNA, 530 bp, Homo sapiens
cacccgcacccccaccctctgctccctcctcagaatagaaggaaacttccacaagtgcaaaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaata

SEQ ID NO: 428749 - DNA, 522 bp, Homo sapiens
attaaaaaattctatataagtttatatatataaaagtctttatactcataaaaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaata

SEQ ID NO: 428750 - DNA, 419 bp, Homo sapiens
  misc_feature (56)..(56): n is a, c, g, or t
gtcagggaggaggaggaaaaatgaagaaaagaggaagttgtgggtacgccactggncttttgcagcctaacactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaata

SEQ ID NO: 428751 - DNA, 2938 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428752 - DNA, 2029 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggttagcggcaagacttgacgcaattaaaataacaatagtatggattataaag

SEQ ID NO: 428753 - DNA, 2033 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttgccgggccggtccaccccctctttatattttaatattattattatataaaaatacta

SEQ ID NO: 428754 - DNA, 2989 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggactggatggcagaggtgggctgtagagccaaagtggggtgggagcgcgaagatggcagctgctgaggaggagccgaagcccaaaaagctgaaggtggaggcgccgcaagcgctgagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428755 - DNA, 1664 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaata

SEQ ID NO: 428756 - DNA, 2868 bp, Homo sapiens
ggcagaggtgggctgtaaagccaaagtggggtgggagcgcgaagatggcagctgctgaggaggagccgaagcccaaaaagctgaaggtggaggcgccgcaagcgctgaggcttgctactcagcctggcccacagaccagaagcaattagtgagacctgggaacataaagaaatgcaaaattttggtcactgatacctgcagtgccaaacctgcattttaacaagatccacgagatttgtatgcatgttaaagtttgaaaagcactgatggtgtgaaatgtggattatctatcaacattttccacaagagaagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428757 - DNA, 1970 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaataacaaaacaaacgagtggccctcgtggccctaccggaggacctctcgcgacgctaacctttactgagggatacttcctcatccctcctcactgcctaactcaccccgcgccataccgcccccccagcggagcccactcactccccagcgggtgccccccttgcacaccaaactaggggcccccacccgcacaaacccgcattcttaacgccctaccccgccccgcacaccgcagtagcgcccatatatctggtccagccgccccgagcctccactctctgcggtgcatgccccgccccccgcacccc

SEQ ID NO: 428758 - DNA, 1733 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaataggaaaaaaaaaagaacctaggaaaataactaaaaaaaactagaaaattaaggtggaggaatacgaaaaa

SEQ ID NO: 428759 - DNA, 1772 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgcattaatgcattaacagattacttttcaaaaaaaaaaaaaaagggggggaaattccgagggcaattggcccgttttgaaaggccaagggataaagggggaaggggaaaggtggtgggatcgggaggaccaaggaagggtctggtgaggg

SEQ ID NO: 428760 - DNA, 2322 bp, Homo sapiens
cggacgcgtgggtcgacccacgcgtccggataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428761 - DNA, 1495 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatc

SEQ ID NO: 428762 - DNA, 2766 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428763 - DNA, 1688 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatcaaaaaaaaaaaaaaaaaacacaaaaaaggggggggggctaaaaatttccctggggggccaagtttacgggttcccagtttttgtacaaggggccctaaggggggggataaaaagagggaggggggggtttaaaacgcgggtggaaaggtctgggcttggaaggagctcttggggggatttgggaacccccggt

SEQ ID NO: 428764 - DNA, 1548 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctaccgcagtatgcggaggatcctcttcttctccttaagttgttcttcctccct

SEQ ID NO: 428765 - DNA, 1934 bp, Homo sapiens
gcatagctgcaacgactctcttaatctccaccgctacacgaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428766 - DNA, 1762 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggctggtgtgcagtggtgcaatctcagctcactgcaacctccacctcccgggttcaaatgattctcctgcctcagcctcccaagcagctgggaccacaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaata

SEQ ID NO: 428767 - DNA, 1804 bp, Homo sapiens
cacccgcacccccaccctctgctccctcctcagaatagaaggaaacttccacaagtgcaaaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428768 - DNA, 1792 bp, Homo sapiens
atttttatttcgttattcaatatacccacaaatccaaccagcaccaccaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428769 - DNA, 1614 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactattagacggactggctgcacctttcctgagaagccagacttccactgatggaagagctgaaaacacaagcccaggagtgcagacactgagaattcccatattaataaagaagaaaattatctgccattttttcctactataataatgctgaatcttaatttagagggtattgtagaatctttattatctcaacaatctaaaaaatgatgtttatttccatagtttgatagtgccacttaaatgccaattaaacaagaatataacatttcaata

SEQ ID NO: 428770 - DNA, 1813 bp, Homo sapiens
cagcccagagcgataaaaaaaacaacaaacaacccacaacccccaccaaaaccccacataaaaacaaaaaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428771 - DNA, 1408 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatc

SEQ ID NO: 428772 - DNA, 2730 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggactggatggcagaggtgggctgtagagccaaagtggggtgggagcgcgaagatggcagctgctgaggaggagccgaagcccaaaaagctgaaggtggaggcgccgcaagcgctgagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428773 - DNA, 1323 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgttgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatc

SEQ ID NO: 428774 - DNA, 1693 bp, Homo sapiens
  misc_feature (56)..(56): n is a, c, g, or t
gtcagggaggaggaggaaaaatgaagaaaagaggaagttgtgggtacgccactggncttttgcagcctaacactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataattggacttctggagtcagactttatatgaccttaggtaaatcttcgaacctcagtttcctttttgtaaaatgagataataacccttacatagaaggtcattgagatgatttgagcgagattaccaagtataagatatttgttataatgccttgtaaatgctttataagtagctgctgttattatcattatgattattttctttttgaagaaaaaaagataatgtttgtaaaactgaattcaaatcataggaaaggatttggccaggcgctgcagctcatgcttgtaatcccaacactttgggaggccaaggtgggaggatcacttgagcccaggagttcaagaccagcctgggtaacaaagtgaggccccacctctacaaaaaaatttttaaattatccagccacaggctgggcacagtggcttacacctgtaattccaccactttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtg

SEQ ID NO: 428775 - DNA, 1400 bp, Homo sapiens
gggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggactggatggcagaggtgggctgtagagccaaagtggggtgggagcgcgaagatggcagctgctgaggaggagccgaagcccaaaaagctgaaggtggaggcgccgcaagcgctgaggtgagcgctgccggacttggggaggagggtgacggcgctgcaagcaagccagggcccacgtggggttgcacggccccgacgctgggtggtgtctctcactgccagcttggggccaacacgcaggacctcccccagctgcccgcttggccgcgaccccttgccagacgttctctccgtttggctgagtccccgcctgtctggtgcagctccggctccagcagcccttcgccagtcgtggcccgcagggggaccgagctggctgaccgcgccacctgcgagcaagcccaggctgggctggtgcgaccccggagggtcggaccggagcagcgtctgtaggcggccgccttctcttcccgggggatggcgggaaagaggctcggcaactgctgtacactggggcaaagtcagaattcttggggatttttcagagtgttgcggaagggcacgttgaccttccttttcgtgcacattctgaaagcccgtacctttgaggaccctctaccagggacccagacccctccgatgctttgcaggggcagcatttggatgaatggataggaaaggttgatttctcttttttatttacactttttggcagcaacggggacagtgctgcccctaacacctgcctcacatgtgattgatgttgcaacttttacttatgaagagtcatttgttaaaatatcccttcctaataagtataaagtgaagcaggcagtctttgatgatttggaaatgttcgctgaaaggcagcgatttttttttccatcttaaaatagacatatcaaactgatttaaaactattaggacactcctgattaaacaggacatatcccatttcttccagtatcactcttcttcacctccaaaggaaggaatcacccacaattgaaaagaaaaggacacttaggggcctggtggtgtgttcatgctgctttgaatggagggtgaacaaatccttgccagt

SEQ ID NO: 428776 - DNA, 1586 bp, Homo sapiens
  misc_feature (297)..(297): n is a, c, g, or t
  misc_feature (385)..(385): n is a, c, g, or t
ttcggagcaaaggcggctctgtcctcgcggttctttgtggaagcaaatgaagacatggtcggctcgcagctgctcctcagcgaactccaggagaactgcaaagctgtccttgctcccctcgggcagcgcgccgcccgggatctcgatgtagaggctgccgccactcagcactgttcgccagttaatgcgtttggcgtctgtgagcctggactggacgttgagaatcctcgtcttgtcgttggacgttagttcctctgttacattcagccgatcatcctgtccagggggtgcagcccnattcagaaccctgactcatcccacaggactccaagaacccggcagcgctaaagcttgggcctaggccgtgttgagctcaggcaacgcntgggctgcaggagactgtgcgccggctctgatgaaactcagggttcccacgattacattcaatcacaggtacgggcagcaaggtgcacaagaagtacctgtggccccagagcagccccagcaggcccggccccatactcacggagtagaataagttagctgaaagattgtgatccctctgactattccctcgcccacctgggatcttcaggggtgggtgaggggcatcaggagcaccaccgaggccccggacccgggttactacagcagtggagggagaccctggaactgaagatgatgcaggtcacgaggcagcgccaggctccgggcggagacccctccagggcgcccgggcggccttcagccctcgtgccgaattcggcacgaggttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccca

SEQ ID NO: 428777 - DNA, 2236 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctccccaaaaaaaaaaaaaaaaaaaaaaaaaaaaaaaaaaaaaaaaacaaacaaaacaaaaaaaaaagaagaaaagaagaagagaaaaagaacaagaatacaaataaacacagaaacacaaatagaaacaaaaagacaggaccacactaagaggacacccacgaattcgacaagaacacgaaaggaacaggacaccaagatcaggacccgactgtacagacaggggcaaaaaccgtgaggcggagaacgaacacag

SEQ ID NO: 428778 - DNA, 2242 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcaggtagcggggctggggccgaaccaggacccccttctcagcgggtgggttccgggcccttccctcagccaccacgcgacgccttgcactgcagccgcgtccccgcagaccgggtgtgggcggccctggggtcgccggggcggcctcggacaggacttcggaagctttggcggatcggatgaaatccgtgtgcccttgccgtgcgcgaggctgttttccgccccttccagcccggggcaggagcgtcctcggcggcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccca

SEQ ID NO: 428779 - DNA, 1932 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccca

SEQ ID NO: 428780 - DNA, 1981 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttatttatttttaaagtcaaaccactaggaaaatatatcacagcctggaaacagcaaacggacaggctatattataatttcaagtaataagttggtgaaaattcaacgaagttgctatcaaaacaataaggtgcgtcgacg

SEQ ID NO: 428781 - DNA, 810 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcaggtgagcggcccgaggcccagcagaggcgctgccaacgtgaaagaccagaaaggcgaggacttccggcctccccgttggccagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataagg

SEQ ID NO: 428782 - DNA, 1987 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccca

SEQ ID NO: 428783 - DNA, 2610 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcaggtgagcggcccgaggcccagcagaggcgctgccaacgtgaaagaccagaaaggcgaggacttccggcctccccgttggccaggtcatgcctgcttctcttgcgcccaacctcgcttcacacagcgcgggtttctacactgttcttctctgagccccgcaatgcctctgtgtgtttcggtcctgcttctctcacggagtatgcgtttcccagatagtgccccttgagtcattgattagtgggtcggctgccctctggtggaatttgtattgctaggttgctgacctctgaaccccatggaagaggctcctggttttcagaatttggcttcgtcagaccaccctaccctcacccactcgggcgaacctctgttcacccaaccatcggtgcaacaggtgccgatgagctagcagcaaggacaccatgaaacactacactagacattgaggataattttccccagtggtggttttaaggtcctggtgtctattctcagggaaggtgaaagcagaaggtggagagagaggtgcaaatatccacgtggccttctaactcctgtagtgctccatagtcatctctgtccccagagactttcctacctaacctctctgccctttctccccagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccca

SEQ ID NO: 428784 - DNA, 1944 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataaggaattgggaattttagtcttttaagcaaagtttacgaatgaagaaatgaaggatggccacaagcgtaaggcatatgtcacttgcctctggacactggttattttatgtttcagtccctaaaaaatgaaatggaaaaaagtggtgctaaatcgagtcagagatattacaggagagttttagagcttattatttcctgtggccagtgcttgtcctggcagtaaggctctcccctgtaacaagccagagccctccaaggtaccagactcttcttactacacaggtactaacaggctggcaggttagagttggtggagtctgaggagagatattttctctttgttgccaacatcctgtttaccaaaagtgtcaccccaccatcttccataagctgtgaaacaaaatcaatgaggtcactaacttagaagggaaagaaagttttctgggtctttgttttcttgatttggggtaatttatacaagggcatacaagttgattttaagatgtggaactgggaggtagactagtttggataagaactttgaaatgttccttgtggatccccatttctggtcatcaagatgtggatgtacatttcttaaaattattacatgctgcatctttcagcctggagactgtgcagaaacatgagaggtgatgacacactaattatgggaagcagaattactggctgatggcccctgaggctgtgtgtaacaaaatgacaggacaatcttgcagtaacactttccccttgaagagaagggggttttgattgtgatatatactagtatctaggaatgaacagtaaaagaggagcagttggctacttgattacaacagagtaaatgaagtactggatttgggaaaacctggttttttagccccctgaattaacagagcccaattgagacaaacccctggcaacaggaaattcaagggagaaaaagtaagcaacttgggctaggatgagctgactcccttagagcaaaggagagacagcccccattaccaaataccatttttgcctggggcttgtgcagctggcagtgttcctgccccagcatggcaccttattgttttgatagcaacttcgttgaattttcaccaacttattacttgaaattataatatagcctgtccgtttgctgtttccaggctgtgatatattttcctagtggtttgactttaaaaataaataaggtttaattttctcccca

SEQ ID NO: 428785 - DNA, 728 bp, Homo sapiens
atgttcatagtcaccactttattcataatagctactaagtggaaaagacccaaacacccatcagcaggggaatggatcaacaaatgtgggccgggaccgatgcctcatgcctgcaatctcagcactttgggaggccgaggtgtgtggatcccttgagctcaggagttggagaccagcttggctaacatggtgaaaccccgtgtgccgattccatatgggcgccggcgcggagcgccgcggggcagcgcggggtcgccatggctgagctgcagcagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcagcagctggacagttgtgtgaccaagtgtgtggatgaccacatgcacctcatcccaactatgaccaagaagatgaaggaggctctcttatcaattggaaaataaaagtatttgccagtggccatcagggctgagggcaagaatatattttttataagg

SEQ ID NO: 428786 - DNA, 2386 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggtgtgtggccgcacatgaaaacatcatttggtgctggagctgatactggttgtttagctccgggtgtatccaaacctacttaggatgaggccggtgtgaccaagcccctggtgggggccctggggtgcatcttctgtcccctgtacccgcccctcagcctttgcaccccgccctccggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggtgagggggtcctgggcggactgggtggtgagtgttctccccttagtggccgggacgtgtggccgggaggttctcaggcctggacctttcccatcagggccctgtgtctccacccttcagaggaagactcaggaaatagaaccgaactcatttttagattggaaaggaaaacaggtttcaaagtgatgtgtatggccaggcatggtggctcatgcctgtaatcccagcactttgggaggctgaggtgagtggatcacctgaggtcaggagtttgagaccagcctggccagcatggcaaaaccccgtctctactaaaaatacaaaaattagcagggcgtggtggcgcacaccagtagtcccagctactcgggaggcagaggcatgagaatcgcttgaacctgggaagcggaggttgtagtgagctgagattgcgcctctgcactccagcccgggcgacagagcaagactgtgttgcc

SEQ ID NO: 428787 - DNA, 495 bp, Homo sapiens
acgcgaaaagcgatatcgaattcgcggccgcgcgacgaagacgacagaagctgggggtgctcttctcgcccctcctccccgccgtgcagatcatcaagctgctgctcgtcttctatgtcaagaaggagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428788 - DNA, 480 bp, Homo sapiens
ggcagagccagtacgtggcagggctggttttaaattgagtcaggctggctctgggctgctgattacatttcccttttcactttggccactaggaagcttagatccacacatacgcccacttcctggctcttggtttttccttgtccttgtttggtggccctttcaccttttcttttatgtttttgctgcttgcgatgttgaatacacctcgtgagttttccctcaaatgcagtttggaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428789 - DNA, 2892 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428790 - DNA, 2845 bp, Homo sapiens
aggtgcggctactcccccggccccggcagacctgcgactggcccagtcgcccctggggccctttgccactcccttggcaaggagagccgagacctcagttcccggcggctcttgcggggcacagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428791 - DNA, 2960 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccaggaatgggtggtgtggacagctgccaggcgttgaagaccacccctggctctgtgcccctgtctcatcagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428792 - DNA, 2169 bp, Homo sapiens
ggcacggccacactccgcatcctggccagcatgcccagccgcaccattggccgcagccgaggtgccatcatctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428793 - DNA, 3039 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggagggccctgtgtctccacccttcagaggaagactcaggaaatagaaccgaactcatttttagattggaaaggaaaacaggtttcaaagtgatgtgtatggccaggcatggtggctcatgcctgtaatcccagcactttgggaggctgaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428794 - DNA, 3313 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggtgtgtggccgcacatgaaaacatcatttggtgctggagctgatactggttgtttagctccgggtgtatccaaacctacttaggatgaggccggtgtgaccaagcccctggtgggggccctggggtgcatcttctgtcccctgtacccgcccctcagcctttgcaccccgccctccggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggtgagggggtcctgggcggactgggtggtgagtgttctccccttagtggccgggacgtgtggccgggaggttctcaggcctggacctttcccatcagggccctgtgtctccacccttcagaggaagactcaggaaatagaaccgaactcatttttagattggaaaggaaaacaggtttcaaagtgatgtgtatggccaggcatggtggctcatgcctgtaatcccagcactttgggaggctgaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428795 - DNA, 3319 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggaaaaaaaaaaaaaaaaaaaaaaaaaaaaaaaaaaaaaaaaaaaaaaaaaaaaaaacaagagagagagggcgcgcgcgcgcgcgccgaaagagatatctcctcctccgaggagcggcgcccccagagtcgagcgccgagcccaccctagtcttttggatcaacgagaggggcgccccacaaagagggagcggccgtcatctattataaagcgcagcggcggcggcgcgagcgcgaggcgttcttcaaacaaagacggacgcgctgggagagcgcgtgaggaaaacacctgcggtggcaaaaaagcgggggggacaccccttctggggagagaaaagagaggagccacctctctatttctgctgtggggcgtgggagagcgacaaaactatgtgggggcgccacaagcactcctctgcgaccaaggaac

SEQ ID NO: 428796 - DNA, 1213 bp, Homo sapiens
agctagtaagcggtggatggagagcgcctgtggtggctctcactggggccctactgtgcgtctgcgcctggacgatgactcccggtacgaggtgtacgtgggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428797 - DNA, 2929 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaaggagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatggaaaaaaaaaaaaaaaaaaaaaaaaaaaaaaaaaaaaaaaaaaaaaaaaaaaaaaacaagagagagagggcgcgcgcgcgcgcgccgaaagagatatctcctcctccgaggagcggcgcccccagagtcgagcgccgagcccaccctagtcttttggatcaacgagaggggcgccccacaaagagggagcggccgtcatctattataaagcgcagcggcggcggcgcgagcgcgaggcgttcttcaaacaaagacggacgcgctgggagagcgcgtgaggaaaacacctgcggtggcaaaaaagcgggggggacaccccttctggggagagaaaagagaggagccacctctctatttctgctgtggggcgtgggagagcgacaaaactatgtgggggcgccacaagcactcctctgcgaccaaggaac

SEQ ID NO: 428798 - DNA, 1140 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428799 - DNA, 672 bp, Homo sapiens
ggcagagccagtacgtggcagggctggttttaaattgagtcaggctggctctgggctgctgattacatttcccttttcactttggccactaggaagcttagatccacacatacgcccacttcctggctcttggtttttccttgtccttgtttggtggccctttcaccttttcttttatgtttttgctgcttgcgatgttgaatacacctcgtgagttttccctcaaatgcagtttggaacaggatggctctggatgggctgatggatgatttctcctcccctttgtgttctggcctttctaggagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428800 - DNA, 281 bp, Homo sapiens
gccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacaggtaatgcctccacctcatgacccaggctccgagctccactcatccatccattcatctttcgacccattcattgattcttccctcttcctttcttccttctgtccatctacctgtctgctctcatccactcaccta

SEQ ID NO: 428801 - DNA, 309 bp, Homo sapiens
cgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggagggtgagtgagtgggcactggagccccagtggcggacaccggcctggggtggggtgcaagaggccagcctggcctgggcggtggctggggtgctgcagagccagaggcccctctcctatcccttagcaggctgcctgaaggcccccccgtccctctgcag

SEQ ID NO: 428802 - DNA, 2090 bp, Homo sapiens
ggcacggccacactccgcatcctggccagcatgcccagccgcaccattggccgcagccgaggtgccatcatctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctgccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggtgagggggtcctgggcggactgggtggtgagtgttctccccttagtggccgggacgtgtggccgggaggttctcaggcctggacctttcccatcagggccctgtgtctccacccttcagaggaagactcaggaaatagaaccgaactcatttttagattggaaaggaaaacaggtttcaaagtgatgtgtatggccaggcatggtggctcatgcctgtaatcccagcactttgggaggctgaggtgagtggatcacctgaggtcaggagtttgagaccagcctggccagcatggcaaaaccccgtctctactaaaaatacaaaaattagcagggcgtggtggcgcacaccagtagtcccagctactcgggaggcagaggcatgagaatcgcttgaacctgggaagcggaggttgtagtgagctgagattgcgcctctgcactccagcccgggcgacagagcaagactgtgttgcc

SEQ ID NO: 428803 - DNA, 715 bp, Homo sapiens
  misc_feature (674)..(674): n is a, c, g, or t
  misc_feature (697)..(697): n is a, c, g, or t
  misc_feature (706)..(706): n is a, c, g, or t
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgcttgacagctggcctggcctgtntcgcctgaggcctgatgcgggcntccctgacnatgggcagt

SEQ ID NO: 428804 - DNA, 2546 bp, Homo sapiens
ggcacggccacactccgcatcctggccagcatgcccagccgcaccattggccgcagccgaggtgccatcatctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctgccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428805 - DNA, 2790 bp, Homo sapiens
gcaggaagcggaggaaggtgaagtaggaccgaattcctgtgccgaagaggcctgcagtgggagagcaggatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428806 - DNA, 1867 bp, Homo sapiens
cctcactgcccctgcctggcctcctcctgctctgcccctgtggctgtcaggcctgagggtcgggtggggcgtggggaaagtccctgactcggctggatctccctgtggcagggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428807 - DNA, 2712 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428808 - DNA, 1377 bp, Homo sapiens
tcttggaggagggaggtgctacctgccagttccaccccgggcccttccctgtagctgcccgctcccaccatggatggggggcttccatgacaccgctccctgcacccctgcagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428809 - DNA, 2502 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaaggagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgg

SEQ ID NO: 428810 - DNA, 1862 bp, Homo sapiens
aggtgcggctactcccccggccccggcagacctgcgactggcccagtcgcccctggggccctttgccactcccttggcaaggagagccgagacctcagttcccggcggctcttgcggggcacaggtgagccctggctgcgcgcgcgggccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccaggtgcggggatggggggagcctggcccttgcttggaacgtgtccccagtgactctgggcacctgccccctggggaggcagccttgcctctcctcctccacccagccagcccagggtgccacgtacgctgtgccccgtgctggggccccctccgagccccacttctcagccccttgtcctgtctcacggttttattttttggtttctggtttcttttccactacttgtacccctcc

SEQ ID NO: 428811 - DNA, 371 bp, Homo sapiens
gggattacaggcatgagccaccgcacctggccatcctggctcctgtctcgtctggccttttgtttcctcatccctgcagtggggaccatgttccagtggggactgagggaggtggtgtgtacagtgttgtgtgcagagcctggcatggcagcgaccttcagcagatggaggtgctgttggcatcacccgtttgcgtgcaagtgaccggcaggcttctgtcttcctctgtaaatgaggaggctgcagggagcagggtccaggctctgcctggacgcacagccctggtcgcccttccctcttgagctcccccagggcttggaggggtgctgaggggtagcaggatggtggcagagcgcagcctttccccacag

SEQ ID NO: 428812 - DNA, 2650 bp, Homo sapiens
actcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428813 - DNA, 2582 bp, Homo sapiens
actcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagtctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428814 - DNA, 2592 bp, Homo sapiens
actcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428815 - DNA, 2606 bp, Homo sapiens
tgcggcgtcaggtcctgttcaactcttgtttcaggcagtgggcgaccctaggaggaccttcgcccctcagtcaatagctggagtgcccgccagacggtactcggtcagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428816 - DNA, 2527 bp, Homo sapiens
actcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428817 - DNA, 2671 bp, Homo sapiens
actcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaagtgagttctgttctgcatgtgttatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428818 - DNA, 814 bp, Homo sapiens
tccaagccaaggaacaccaaggattgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaagagtaatacaatgaaaaaattg

SEQ ID NO: 428819 - DNA, 441 bp, Homo sapiens
actcccaagaggccacgcgtagacggggcgcttcatgcggaagtcagcggcgtccggtcccagcctcctctgggagcgggcagttggcgaccctgcactgacccgcgtccctccgtcccgagcccgcgcgccctcagagggtgcccggacaggtaaatggagtggggtgcgcctgcgggaggcggggagagaactgcggagggagggcggaggtgtcgatggaaaggtgctggggtggagcgaggaggcagtgcaggggtgacttgggcttctctggtgtcgacagttccagttgtcgggcaggaccagttttggcgaggtgcgtcttatgccactggaaaggcctcgagttaaagagtgtcagaatgcgtcacttaagctgtcattacaggagggaaaaaatgttaactttctctcagtttgtattctacaagacctttc

SEQ ID NO: 428820 - DNA, 4959 bp, Homo sapiens
cggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttagtctgatgacgaggaagcccgccagaaagtccagaagaaggaacgacggacgcaaagcggcgccgcctaccatgcctcccccccccaccaccaccccccccaactgtggtcgtccccgcccggcccaccccgcccccatttctccccccttctttcaataaaaatttcaatcataaaaaaccacctataaaaaaaaaaa

SEQ ID NO: 428821 - DNA, 315 bp, Homo sapiens
accgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctcgttgcagccagataacttcgctctgatagaggtggaggatatacctatggttctcccacacgagtgcctcgtggg

SEQ ID NO: 428822 - DNA, 5048 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428823 - DNA, 5046 bp, Homo sapiens
agtttctgacaaaaaggacctgaaaaatcactgattctagaataggggagtgtcaaggggagttcatacccatgaatctccaccggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428824 - DNA, 4635 bp, Homo sapiens
agacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428825 - DNA, 5081 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428826 - DNA, 5012 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428827 - DNA, 5566 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428828 - DNA, 4910 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428829 - DNA, 4497 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgtggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428830 - DNA, 4472 bp, Homo sapiens
  misc_feature (4183)..(4183): n is a, c, g, or t
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactccccgtcggtccccagcccagctggncagggcacgaggaagcgatggggggtactgggaggaatcgatgggggtatggggtccaagacgaggagggggcagggacgcggggacagacactccaagtctggaaagtttgggcacagaaggtggagttggaggcagcgactcgttgagaccagcgagctcgtgtcccagggttggaggcgggggtagggtagtaggtgtgtgtggaggggtgcacactcgatccccgaacccgactgacccgtcgttcccccagccccgcccgcttccccagcccggggatcgtcgt

SEQ ID NO: 428831 - DNA, 5509 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428832 - DNA, 5234 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428833 - DNA, 4835 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428834 - DNA, 3004 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgtacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428835 - DNA, 1714 bp, Homo sapiens
  misc_feature (8)..(8): n is a, c, g, or t
caagcttntacccctggctataacccaacccaggggcggaatcccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428836 - DNA, 1453 bp, Homo sapiens
cccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428837 - DNA, 3134 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccacgcctcccactgatgtcgtggtcccgggcctggcccaggggcccctttacatgccctctcccttttataaaattttccattaaaaaccacctattttctaaaaaatg

SEQ ID NO: 428838 - DNA, 443 bp, Homo sapiens
gacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccct

SEQ ID NO: 428839 - DNA, 558 bp, Homo sapiens
agcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacag

SEQ ID NO: 428840 - DNA, 702 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggac

SEQ ID NO: 428841 - DNA, 5325 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428842 - DNA, 4774 bp, Homo sapiens
cgcccccagcaaatgctccagccacaggcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428843 - DNA, 5174 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428844 - DNA, 5434 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428845 - DNA, 5692 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428846 - DNA, 2070 bp, Homo sapiens
ttgcgtatctaagatcctatccggtctgggtacagcggccgaggcctgtagattgatagatgtggatgagtgccaagaatatggtcccgagatttgtggagcccagcgttgtgagaacacccctggctcctaccgctgcacaccagcctgtgaccctggctatcagcccacgccagggggcggatgccaggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428847 - DNA, 4617 bp, Homo sapiens
  misc_feature (4203)..(4203): n is a, c, g, or t
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccacctgtgacgatgtgnacgagtgtgaaacactacagggtgtatgtggagctgccctgtgtgaaaatgtcgaaggctccttcctctctgctgcccagcagctgggcttccacctgtgcctcatgggctggctggccaatggctccactgcccaccctgtggttttccctgtggcggactgtggcaatggtcgggtgggcgtagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagccggggtctcgactttcctgaactt

SEQ ID NO: 428848 - DNA, 4184 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgccccccctttacatgccctctcccttttataaaattttccattaaaaaccacctattttctaaaaaatg

SEQ ID NO: 428849 - DNA, 5294 bp, Homo sapiens
  misc_feature (3843)..(3844): n is a, c, g, or t
  misc_feature (3846)..(3846): n is a, c, g, or t
  misc_feature (3886)..(3886): n is a, c, g, or t
  misc_feature (3975)..(3975): n is a, c, g, or t
  misc_feature (4005)..(4005): n is a, c, g, or t
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaganngngccctcacaggccggttcctcatcggcgcactcgtcattntcgatgcactccagccgctgtgtgtggtagtagtagccgttgctgcaatagcatgagtagcccggggccgtgttcacacacacgccacncttgcacacctggtctcggaagagctgacnttcgtccacgtctctccggaggctcaggtctccactgggcgccaggtagccccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428850 - DNA, 5227 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428851 - DNA, 1638 bp, Homo sapiens
ttatgcgtatgtgcacgggccgcccgcctggacctggagaagggactacggacgcctggaagctgcgacgccctgcacctgtcccgcctccaccagcgcctcccactgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaatg

SEQ ID NO: 428852 - DNA, 3904 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgatggggaaagcccaggggggttttggaggaggcgcctggcccagcatgagaagaggattagggagttcttcctgtaggagacgacatctgaa

SEQ ID NO: 428853 - DNA, 2088 bp, Homo sapiens
gctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaa

SEQ ID NO: 428854 - DNA, 2219 bp, Homo sapiens
gcagcccactcttcccgagaggccccgacatctcccggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 428855 - DNA, 1649 bp, Homo sapiens
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcggtgagtgccacctcctatgggtgctgagggatccccagcagaggatccctcagcagagggacttgactgctttccagaggactcgactgctttggagactgtgggaagagagggaaagaggtctgaagagcgtagattgtcccaagacatggtccctggacacatgggctgcactgggggaggggtgtggtgagggatgcctggagcaatgccaccctctcctccaacattggtgtggggcaaagttccaccagcacagtagagggctgggctgtgtcctctgggcatcaacctgggctctgcatcagacacactgggcatcaaccccggtgccatgatgtcctatgaggtctcaggcaagttgctgaatcttgctgagtcttggcttccctgtctctggaaggtgaagggcatttcttcacagggctgtgtgaagatttaatgagatgaggcctatgaagcgcctggcacagtggtcatttattaattcctccacctttgctattaatagcattatcatcattattgttaccccacctcctctccacaagtatgaagccagacatgctgaacttgactttcctctgctgatcacgagtgtgttcaaagcgcagagacccagctgttgtcacggaagaaaatccaagctttggttcagcgtgtctgctcactttaggtgttcacagccccttccctcctcatgttcccaatgagaagaggttgtgttcactcatgaaagctgtgtgaccgctccttagggacatgagtgggtaaatgtaacataa

SEQ ID NO: 428856 - DNA, 2329 bp, Homo sapiens
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 428857 - DNA, 2099 bp, Homo sapiens
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 428858 - DNA, 1145 bp, Homo sapiens
ggcatggtggcgcacacctgtaccagctactcgggaggctgaggcaaaagaatcgcttgaacctgggagctggaggttgcagtgagccgagatcacgccactgcactccagcctggacgacagagcaagactccatctcaaaaagttttttcccccagaattacctacaagtgcattactatccaatgtggattttttaggacattttaaaagtgaatttgtttaaatgtgtcatttcagcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 428859 - DNA, 1769 bp, Homo sapiens
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttggtaagcaacctcccaggtgggaccttagaatggataggaatggggaaatgatgagggggtagacatccagcagccggtaaaacacctctaggacttaccacaacagctcttcaagacacattaagtaagtattgttattaaccccacttttatacacatcccaccccatgggaagactgagacccagaggaaaatgatttgtccaaataacttgttagcaggtccaggacttcatccttgtctttcgactccaactcttatacttttcccattgtttggagagaattttggccaaggtttggtgttacattacaataaaggggcctgacaccatattatttgcaa

SEQ ID NO: 428860 - DNA, 1313 bp, Homo sapiens
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgcagaaggatatcctggggaggtcaagttccttaactcttagttgtacaaatggtgagagccacacaagctgccaaccctccagccacccagattctgtgtcctccctttcttaaggctgaggctttataaacctgattttgactacagttttgttt

SEQ ID NO: 428861 - DNA, 684 bp, Homo sapiens
gggtggagggaggtgttaatttcctagggctgcctcaacaaacctgagggcttaaaaaaccaggaatttattctctcatagttttggagcccaaaagtccaaagtctaggtgtctgcagggccacacttcccccagaggatctaggagagaattctgctgccttgtctccttccagctgcggatggctcctagtgttcctggctcatggcagcagcactccagcctctgctctgtctccatgtgggcttcccctctgtgtgtgtgtgtgtcttctcctttactgtctgttataaagacaccatcattggatttagggcccaccccaatctaggatgatctcattttgatttccttactttaattacatctgcaaagactaaggtcacgttcttaggttccaggtaacatatgttggtgggccactactcagactactgcaagggggtcgtgtggtggaatctataaagtcagcctgttccatttagaacagagaaataaataggcttttgcactgttgtgttttgcagcagaaggatatcctggggaggtcaagttccttaactcttagttgtacaaatggtgagagccacacaagctgccaaccctccagccacccagattctgtgtcctccctttcttaaggctgaggctttataaacctgattttgactacagttttgttt

SEQ ID NO: 428862 - DNA, 619 bp, Homo sapiens
acatcagtattttattttttattgctgtatattattctatatattatagaaacattgatttcttaaaaatataatcacataactacttggccacctaaatatactggcaatacttttaaaatattatcagtgttcagattttcctagttgttttgtgcatgtcaggtttcatttgtctgtttagaatcagtttgttcaaatcaggataaaataatatttccaatgttttaaagattgtgtccagcctgttcagagaatatatattagggagctttatgtaagaacagccatttccttatttgttggaagtggctgggcttttggtcaagcaacataatgtgtgtagggatcgaattttatggggaagatggatgggtcttctgctccactgagttacgtctaagatgtgccatcaaggctgggctgaccctgtccagacttgttggcacaccttagactcaactttacctaacttgtccttttctcctgcactacagagttctgccttctccgagggaagcaaggtggcttcgagaacaagaagagaattgactctgtctacctggaccccctggtctttcgagagtttgcattcatagacatgccagatgctgcgcat

SEQ ID NO: 428863 - DNA, 473 bp, Homo sapiens
gattaggtataaaaagcaggagttgctgtccgacgtcgtgagatgtgcatcgcagtcatgagacttgggtgtgctttgttttcacagcgaccctgctcctggagaggaatttccatccatttgcggagctgcctgagccacaacagacagctttgagtgacatcttccaggcggtcctatttgatgatgaactactcatggtcctggaaccagtggtgagccctgagacatctcaaggcagtgttttcactggggttttctggaacaggggaggaggcaggatggaattgtgttaaaggttcccccgcctccttttctccctacagctgtctcttttctgactcttgggtcctgcgttttctaagtgcagacaggtagctggcatcgggtggagggaggtgttaatttcctagggctgcctcaacaaacctgagggcttaaaaaaccaggaatttattctctcatagttttgg

SEQ ID NO: 428864 - DNA, 1906 bp, Homo sapiens
agcatccccctggctgctgccccacccccttaatagcctacactctctcttgagaacgagccatgtactctctgggtcacacctcaacaacacactgtctttacaaataaggctgctaacacatggcaggaacaactgagttcctaaccagtccctcggctacctgattcagcacgtgactcattcttttttgccttttcagctcaaagcttgtacccccaagggactatggtccttttaagaactgtatctgtgttttccctgggaggtgtttaatatccactttgaataacactgatctggcattcccttccctggggcttggcaagggcccttctggtgcagcccctagcctggcacagctctgctccaactttctgctgttgctgctcctggcctcaggccacgctgcactgataaagctacactgcattttcctccccaaaatgattggtgatggggtagagccctttatagtttacacagtattctgacatatgcaaaaacaaaacaactatggtaaatgaggaaactgaggctgagagaggtgtacctgaggctgcagcctgaatgtgtggagggtctcaaacatcactcttctgtcaccagatggcagggtctgcttttccatgctgtttcctttccttcccccagagtctgggcagttctttccatttggtaaattgaatgtcaaggagtatcctctgtggaatgcagagctggcagctgggttcctacatctgttttctacaaggtctttgctgcccatttagcaccattcattcactaactcagcaactgctgagtacctcccctgcctggctggcgggaaagtactaaaatataagttaggtgccatccaggggctggctctgttcccatggacttgtttttttggactgtgactgtgatttttctctcctgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 428865 - DNA, 890 bp, Homo sapiens
gggtgaggtcgacgggtatcgataagttttttgttttttattttttctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaa

SEQ ID NO: 428866 - DNA, 2805 bp, Homo sapiens
tgtttttagtagagatggggtttcaccatgttggccaggctgctcttgaactcctgagctcaagtaatctgcccgccctggcctcccaaagtgctgggattacaggcatgagccaccatgcctggctaaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagagcactttgggagtccgaggcgggtggatcacctgagattaggagttcaagaccagtgtgaccaacatggagaaaccccttctctactaaaaatacaaaaaattagccaggcatggtggtgcacgcctgtggtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaa

SEQ ID NO: 428867 - DNA, 3127 bp, Homo sapiens
tgtttttagtagagatggggtttcaccatgttggccaggctgctcttgaactcctgagctcaagtaatctgcccgccctggcctcccaaagtgctgggattacaggcatgagccaccatgcctggctaaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagagcactttgggagtccgaggcgggtggatcacctgagattaggagttcaagaccagtgtgaccaacatggagaaaccccttctctactaaaaatacaaaaaattagccaggcatggtggtgcacgcctgtggtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaactcaaaaaaaaaaaaaaaaaaaaaaaaaaaaaaaaagggggggggggaaaaaagtatttcccttggggggccaaggtttaacgcttatcccaggtttttttgacaaaggggggcccctatataggagcagaattaaaaaggaagggaggggcgggggtaaccacggtcggcgcgggaaaacctgcgtcgtgggatcttgggaagggagccttcttgggtgtgtgcgtttgttgggcacacttcctaaaagttaatgtctaggaaatataatttagtgtttgtgtacaccggtttctgtgtagaagttgttaagtgttagatt

SEQ ID NO: 428868 - DNA, 2351 bp, Homo sapiens
tctggtgtatcccttagtctggtgtttccctttgtctggtgtttccctttgtctggtgtttccctttgtctggtgtttccctttgtctggtgtttaccctttgtctggtgtttccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagagcactttgggagtccgaggcgggtggatcacctgagattaggagttcaagaccagtgtgaccaacatggagaaaccccttctctactaaaaatacaaaaaattagccaggcatggtggtgcacgcctgtggtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaa

SEQ ID NO: 428869 - DNA, 2108 bp, Homo sapiens
aattggcattgtgagactttatatttttgcctaaatgtaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagagcactttgggagtccgaggcgggtggatcacctgagattaggagttcaagaccagtgtgaccaacatggagaaaccccttctctactaaaaatacaaaaaattagccaggcatggtggtgcacgcctgtggtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaa

SEQ ID NO: 428870 - DNA, 2877 bp, Homo sapiens
tgtttttagtagagatggggtttcaccatgttggccaggctgctcttgaactcctgagctcaagtaatctgcccgccctggcctcccaaagtgctgggattacaggcatgagccaccatgcctggctaaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagagcactttgggagtccgaggcgggtggatcacctgagattaggagttcaagaccagtgtgaccaacatggagaaaccccttctctactaaaaatacaaaaaattagccaggcatggtggtgcacgcctgtggtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaaacctcaaatctgtccttatacaaatatttgatttctagtttccttttattaaaacattttcactcattcatt

SEQ ID NO: 428871 - DNA, 2741 bp, Homo sapiens
tgtttttagtagagatggggtttcaccatgttggccaggctgctcttgaactcctgagctcaagtaatctgcccgccctggcctcccaaagtgctgggattacaggcatgagccaccatgcctggctaaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaatttccctgagttgctggccttattagtccctactctgttgccccctggttacctaatgcatgttcaaaaggtatagttttcatcacctgcttgatcttgattttcagacagcatcaaatcagttgcaaaacaaatccaagctaaaattttgagtgtatgattaatttactatagcatgtaattatgcagtattttattttttattttttattttttttgagacagagtctcactccattgcccagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaa

SEQ ID NO: 428872 - DNA, 1146 bp, Homo sapiens
tgcaccaccacgcccagctaattttttgtatttatagtagagaggaggttttaccatgttggccaggttggtcttgaactcttgacctcaagtgatctacacgcagcactttgggagtccgaggcgggtggatcacctgagattaggagttcaagaccagtgtgaccaacatggagaaaccccttctctactaaaaatacaaaaaattagccaggcatggtggtgcacgcctgtggtcccagctacttgtgaggctgaggtaggagaatcgcttgaacccaagaggcagaggttgcagtgagctgagatcacaccactgcactccagcctgggtgacagagcgagaccctgtttcaaaaaaataagaaataaaaagtgagtcttcatattcaaattagtatatgaggttaggcaacaattcttatatgggaccaggtatatttaatttgcctttctttgcagtcatcctagtaaatccttgtaaagggttattttatatacaattttgtagtatattctaaatcccctttggcaaataaagctgaagttatctagtgtcagcatactgtgatttgtatatttatataagacaagattgcatcattctgattaagttgcagcattttagttttatctgataggcctgtattgagtaatcagtagctatgtgcaaatattaagtcaacttaattaccagacccagaaggccagaggtaatcaaagagtactttcggaagatgaaatatttataatgagttatggaaacaatgttttagaaatgtttttcttggtgtaatttaatgcagatttttacctcaattttgttaaaaaacttgataatttgatccctccatctatttaatatttaatattttcagattctagagtatttaaaatttaaacacaattataaaattaattataattcctacttatgttagctatgatttagggccaaaactaccctggttttgtcttgcaacttgaaacattgtgtattttaaactatataatttgggaacattattttatagactgtggataaccaaatataagatttgtgatttttaatgcttcatttgtgtaaaatcatttgtatattctatttatagtatgcattttctagctcattaaaagtacagaaaa

SEQ ID NO: 428873 - DNA, 1703 bp, Homo sapiens
  misc_feature (1667)..(1667): n is a, c, g, or t
tgtttttagtagagatggggtttcaccatgttggccaggctgctcttgaactcctgagctcaagtaatctgcccgccctggcctcccaaagtgctgggattacaggcatgagccaccatgcctggctaaaaccaattctttagattgtttttgccaccatttgcttacttggaatagctttcacatttatttttcttatgaagaaatccagtgtcagtcagaccatgtaacatcaaagcaaaatttcattgaagcctatccttgtcttaattattctaaaataaagtacaataaagtgaattattttgccctttgtagtagcatagtgttaagttatatatatattttaatatgcatactcctaagtaaagtttcagagaccacatgctggagagcagtggctttcagacagcatcagcatcacctgaaggccttgttgaatacacattattggaagagaggggagaacacaggctcatgcctgtaattccagtgctttgggagactgaggcaggaggatcacgtgagcccaggagttcaagatcaggctgggcaatacagcaagacccctgtctctacaaaaacaaaaacaaaaaacaaacaggcatggtagtgcatacctgtagtctgagctgcttgggagtctgaggcaggaggatcacttgaacccaggagttcgaggctgcagtgagttattattgggccactgcagtccagcctgggcagcaaagtgagaccctgtctgttaaaaaaacaaaaccaaaaacttgattgctgggggccaccctagagtttctgattcagtaggtctggcggtggggatggtgggcctggtaatttgcctttctaacaagcgtccaggtaatgccccagctgctggtcccaggaccacactttgcagattattactctgagaagagcactaactctgacgttggattccttctgttcctcattagtgaatttatttgggggagattattcaatctggtagatccgcatttacttagctgtgaagtggaggttaatgcaacctgcctgagactgtgagaatgagaaactctaattgaaataccaggcccagcgtgcctggatgcttgaaaaatgctgactcccatggtccgtccttccctcactcttctcagctataaagtgagaagcgaaattcagtatcttttaagattcctctcaggtgtaaaatgctgtgattctaaaagtttaattttgtagttccagagacaatgccaaacacctgtgtgtgcttagtgctttgtaaagagtggtaataacagtgacacccacataggccgtagttttgtagttccagagacaatgccaaacacctgtgtgtacttagtgctttgtaaagagtgaataacagtgacaccacataggccatagttttgtagttccagagacaatgccaaacacctatgtgtacttagtgctttgtaaagagtggtaataacagtgacaccacataggccgtaattttgtttttgcttttgttagggtgttcagcatcttgactccttaaataaggttttcagtcagatttataaagcagcattgaagaagttgtattatatttgagtacagttggaatccatggcagttttatggaggccaaatatatcagatgaataggctaattgcacgagtcttgngcaagaaagggatactctagaacgccgcacccacac

SEQ ID NO: 428874 - DNA, 1490 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatact

SEQ ID NO: 428875 - DNA, 1330 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgtgagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatact

SEQ ID NO: 428876 - DNA, 774 bp, Homo sapiens
tgccgccttgcagtttgatctcagattgctgtgctagcaatcagcgagactccgtgggcgtaggaccctccgagccaggtgcaggatataatctcgtggtgcgccattttttaagccggtccgaaaggcgcaatattcgggtgggagtgacccgattttccagtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatact

SEQ ID NO: 428877 - DNA, 521 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagtatccaaagaaatttgaaataaaaataac

SEQ ID NO: 428878 - DNA, 6235 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428879 - DNA, 6133 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcagtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428880 - DNA, 6055 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaagcctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcagtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428881 - DNA, 5519 bp, Homo sapiens
tgccgccttgcagtttgatctcagattgctgtgctagcaatcagcgagactccgtgggcgtaggaccctccgagccaggtgcaggatataatctcgtggtgcgccattttttaagccggtccgaaaggcgcaatattcgggtgggagtgacccgattttccagtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428882 - DNA, 6075 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgtgagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428883 - DNA, 5973 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428884 - DNA, 3999 bp, Homo sapiens
tcaatttctacaccacagagaaatgcaaatcgaaaccacagtgagatatcatctcacaccagttagaatggcaatcattaaaaagtcaggaaacaacaggtgctggagaagatgtggagaaataggaacacttttacactgttggtgggactgtaaactagttcaaccattgtggaagtcagtgtagaaattgaacttcaatttctacactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctaaccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtcatc

SEQ ID NO: 428885 - DNA, 1388 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcagtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatact

SEQ ID NO: 428886 - DNA, 3775 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactgga

SEQ ID NO: 428887 - DNA, 1973 bp, Homo sapiens
agcgggtggagcggccggctgggtggcccgcgagctgcacccggatctgctccgcggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaagatagggttggttctgacgtaggggagatcgggtgaggatccgaatgtatctgagattcttactaaagttggggcaaaaagttttaatgggcttttcagagaggtcgggcaaggggaaccttaaacgggctacaacgtttaacggttggccaagtgggtggggggatagaacaggaagaggtttgaagaatag

SEQ ID NO: 428888 - DNA, 716 bp, Homo sapiens
gtaggtctggggcgcaccctgagaatctgcatttcttagaagttttaggtgatgctgatactgctgattggggttccacactttgagaagcactagtctaaaggactgtatggcttgttgtagtgaaatgaaaggaagctaggaaaggaaggaattgttgaaatggccttgaaagtaaattagagtttttcaagtcaagtaaattatctagacttcagttttgctcacgttcttccaactttaaacaatgattgctgttcctagacgtaggtttcctgagcagttcttttgtttcaaacttcttttcagaacaggcttagtcattgactggaagaaagttagggggaaggaaactaaaaggatagttggtttatttatcttgactctaaaaatttggaaatcagcagcagccataattttaactactttatgtcatgttctacatgtatactaaaacatactgtattgttacctttttaagtaacatgaaccaaatgaactcttgaggattcaggttcaccggttttgagcatcagtgattgcactgtgacaccttctggatttctcactgttctgtggatttctcgtttccctctctgcctccactcatcccagatggttgtgctttttgcgtgatatgccctgtctggtgttttcctgcctttcatcactgtcagcagttagcttactggtaataaatagaagaaatttctcca

SEQ ID NO: 428889 - DNA, 1934 bp, Homo sapiens
  misc_feature (77)..(77): n is a, c, g, or t
  misc_feature (128)..(128): n is a, c, g, or t
  misc_feature (378)..(378): n is a, c, g, or t
  misc_feature (467)..(467): n is a, c, g, or t
  misc_feature (494)..(494): n is a, c, g, or t
  misc_feature (557)..(557): n is a, c, g, or t
  misc_feature (640)..(640): n is a, c, g, or t
gaaatattgaaagtaaaactggcaaacatatggggaaatactaaaactcatgaatcaaagaaatgcaaattaaaatnaagagccagctttttaagaaaattacaaatgtcttctattgagggggcaangggaacagcctccttgccccggcagagactggaggtgtcgcacacctctccagagggagctgcgacaaccctgagccactcatctgaaggctccttggcctttcttctagaaacctgacttttgttttggtgatacaaagtgtggggagaccaggaacataaagatgttcaccgcagcgttatttcctaaaaccagaaaaaacctttaagctgtcacgtgagtggagtgatttaaaggtgtggactctgntcaagccagcccagggaccagctcatgtgctcacacaactgggagaccccaggccctgcgggaaccccctgctcctgcactcatgtcangttgttggggtgatcttgctggatagnaggggttctggactttcttcctccctctggggacgccgggtggaaaccccttatgtagaatangggctttggtcttgtgtcgaggaaatgcgactctgggctcttgatgtaaaaacattgtcccacaattgtgtagaaatacatgnaaacggaagagactagaggaatacgcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttatttta

SEQ ID NO: 428890 - DNA, 458 bp, Homo sapiens
gggtttttgttttttattttattttttgagacagtctcccctctgtcacccaggccggagttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428891 - DNA, 244 bp, Homo sapiens
  misc_feature (4)..(4): n is a, c, g, or t
  misc_feature (103)..(103): n is a, c, g, or t
tgtncctgctggtttaatgcagcagccctaggctagaagcagtcctcctgcctgggcctcccaaactgctgggatgacaggtttgaaccactgcacctgcccnatggcagcaaaaagttctcagtgacctattttgtggtgtttctttttgaaaagaaaagctgaaatattattaaatgctagtatgtttctgcccattatgaaagatgaaataaagtattcaaaatattaacattttcataaa

SEQ ID NO: 428892 - DNA, 5896 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428893 - DNA, 6098 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctggccgaattcggacgaggttgaacccggagggaggttgcgtgagctgagatcatccactggctcagctggcagagagccgacttatctatataaatatagtcagacctttagaaatgctacagtggttggcacggtggttacgcctgaatccaagacttggggagctgagccggccgatggctgaactcagaattcaaaccagcctgggaaacacgggaaccttgtt

SEQ ID NO: 428894 - DNA, 6369 bp, Homo sapiens
ggtatttagtttttatttcataatcataaacttaactctgcaatccagctaggcatgggagggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatggtgatcttcttgctggtcttgccattcctggacccaaagcgctccatggcctccacaatattcatgccttctttcactttgccaaacaccacatgcttgccatccaaccactcagtcttggcagtgcagatgaaaaactgggaaccatttgtgttgggtccagcatttgccatggacaagatgccaggacccgtatgctttaggatgaagttctcatcttcaaatttctccccatagatggacttgccaccagtgccattatggcgtgtgaagtcaccaccctgacacataaaccctggaataattctgtgaaagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428895 - DNA, 4723 bp, Homo sapiens
cgctaggtggggctgggagtaatcggccgaggtagacattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428896 - DNA, 4691 bp, Homo sapiens
tggttttcattaattgcactttattcattttcgttatccttgtaaataaaagaactttcgaaaagtgtgattaacattaagaatttttagaagattcagttttccaaagtagttggctttaaaaataccagactctaacctttaaaatttgtgtgcaaatgaaagttttgtagttatggtttggggtgtgtgtagcttatgttttcccattaaattgttcccagatattcccttaaatatcagagataaataaaaatgactactaatataagccagtaatttcatttttagttaagacccatttaaaatgtgtttatttattttgtctgttttctgtttgttttgggtagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428897 - DNA, 3782 bp, Homo sapiens
aaacctaggcagtgaggcgggtttaatcggacgaggcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428898 - DNA, 3552 bp, Homo sapiens
acattacgagagagggaaactggtctaaaatactgtagcattataaattcaacaacagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428899 - DNA, 3964 bp, Homo sapiens
ggtatttagtttttatttcataatcataaacttaactctgcaatccagctaggcatgggagggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatggtgatcttcttgctggtcttgccattcctggacccaaagcgctccatggcctccacaatattcatgccttctttcactttgccaaacaccacatgcttgccatccaaccactcagtcttggcagtgcagatgaaaaactgggaaccatttgtgttgggtccagcatttgccatggacaagatgccaggacccgtatgctttaggatgaagttctcatcttcaaatttctccccatagatggacttgccaccagtgccattatggcgtgtgaagtcaccaccctgacacataaaccctggaataattctgtgaaagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttatttta

SEQ ID NO: 428900 - DNA, 3894 bp, Homo sapiens
ggtatttagtttttatttcataatcataaacttaactctgcaatccagctaggcatgggagggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatggtgatcttcttgctggtcttgccattcctggacccaaagcgctccatggcctccacaatattcatgccttctttcactttgccaaacaccacatgcttgccatccaaccactcagtcttggcagtgcagatgaaaaactgggaaccatttgtgttgggtccagcatttgccatggacaagatgccaggacccgtatgctttaggatgaagttctcatcttcaaatttctccccatagatggacttgccaccagtgccattatggcgtgtgaagtcaccaccctgacacataaaccctggaataattctgtgaaagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaaaaaattgtaaaaaaactccggggcgcctatggcgggggggggaaaaaggggtttgaaatggcccttggccaaggggtttccggacc

SEQ ID NO: 428901 - DNA, 461 bp, Homo sapiens
cactcatacaggtaccacttctttttcttttttttgagatagagtcttgctctgtcaacagagttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428902 - DNA, 1748 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacccgtggggtaggaggtggggatactctagagcg

SEQ ID NO: 428903 - DNA, 1125 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccagtaagtcaatatttatttcatttttattttcccatttggtggcaaaaatacatacccgtggaagaatatataaagtggagaaacaaaattttatcaactcaccgttgtccctttctgttgtgtgaatcctgtgggagttttttgtatttctttgtgccttaactgagagcttatctcttgataaacagctctctttcctgattataaaaatgttacaaaaatttggaaacatggacttcttc

SEQ ID NO: 428904 - DNA, 361 bp, Homo sapiens
caccaagttgaaaccacaggacttctagaaatctttaaatgtgctgacatatttaaccagaataactagttcctgcaacatattggttaatcagtagttggtttttctaataactttttagaatttagatcacgttgattttgcataacaacaagatcctcccgccctttattttcaaaaccaggtttggtctgttgcgagggtttctcacgagcactcgtgtgtgtcatgcattatatagcattttgtttaaactgagttctttttcctttccagactgtaaaacacatgtggcctttcatttgccaatttatagagaagttgtttcgagaaactatagaaccagccgtgcggggagcaa

SEQ ID NO: 428905 - DNA, 382 bp, Homo sapiens
ttggggcctcatgacaaactctaaaggctttagaccgtctcgttatcttttcaacacatccaccatcaatacataatagtgcatacctgcaaatacatgtcttggaatttaattaaggtcaacctaagcttctagttttttgttttatttattttctttttatttttcattctaagcttctaaacacataaaatgagtagcccttttccacagaaaatatcagagctaataatttggatatttcttctagattcgatacaaaaccaatgaacctgtgtgggaggaaaacttcactttcttcattcacaatcccaagcgccaggaccttgaagttgaggtattttatttgcattttttaaccaatttattgacaaataattga

SEQ ID NO: 428906 - DNA, 669 bp, Homo sapiens
ggttgagcctgactctgtgctgtggttgtgaggctggaatgcggagaggccagtgaacacactggacatgggcgggcagggaggcatgtcctcgggtcagccgtctgagtcacaggcccagagatgcccagctgtgaccagtgctccgcttgcaggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtcttatacagatactatcactttcgggaatatacatat

SEQ ID NO: 428907 - DNA, 6422 bp, Homo sapiens
ggtatttagtttttatttcataatcataaacttaactctgcaatccagctaggcatgggagggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatggtgatcttcttgctggtcttgccattcctggacccaaagcgctccatggcctccacaatattcatgccttctttcactttgccaaacaccacatgcttgccatccaaccactcagtcttggcagtgcagatgaaaaactgggaaccatttgtgttgggtccagcatttgccatggacaagatgccaggacccgtatgctttaggatgaagttctcatcttcaaatttctccccatagatggacttgccaccagtgccattatggcgtgtgaagtcaccaccctgacacataaaccctggaataattctgtgaaagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428908 - DNA, 5965 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaagagagccgaatggctacagtaaggaccactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428909 - DNA, 3808 bp, Homo sapiens
ggtatttagtttttatttcataatcataaacttaactctgcaatccagctaggcatgggagggaacaaggaaaacatggaacccaaagggaactgcagcgagagcacaaagattctaggatactgcgagcaaatggggtggaggggtgctctcctgagctacagaaggaatgatctggtggttaagataaaacacaagtcaaacttattcgagttgtccacagtcagcaatggtgatcttcttgctggtcttgccattcctggacccaaagcgctccatggcctccacaatattcatgccttctttcactttgccaaacaccacatgcttgccatccaaccactcagtcttggcagtgcagatgaaaaactgggaaccatttgtgttgggtccagcatttgccatggacaagatgccaggacccgtatgctttaggatgaagttctcatcttcaaatttctccccatagatggacttgccaccagtgccattatggcgtgtgaagtcaccaccctgacacataaaccctggaataattctgtgaaagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgagtaacccattagaatttaaccccgatgtcttgaagaagactgcagttcagagagctttaaagtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaa

SEQ ID NO: 428910 - DNA, 3712 bp, Homo sapiens
  misc_feature (49)..(49): n is a, c, g, or t
  misc_feature (54)..(54): n is a, c, g, or t
  misc_feature (57)..(57): n is a, c, g, or t
aaaaaattaggctaggtacgaggctggtgtggaatcggccgaggggcanctggnaancgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428911 - DNA, 3509 bp, Homo sapiens
gcctactactactactaaattcgcggccgcgtcgacggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttctgtggttgccgcatttattccacctccagctggaccccccactgcaaatagagaacagcggtgggggatgggggttaaaaagtagagaacctcctttctgttcaactaatttcacgtgacagtgcatgtatttattcaataaaacctttatgttagctcagtaagagatttg

SEQ ID NO: 428912 - DNA, 3438 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattagttttgtaggaaattgtgagattgatttggagatcaaacgatatttttgtagagctggtgtgaaaagtatccagattcatggtaccatgcgggtgatcctggaaccgttgattggagatatgcccttagttggagctttgtctatcttcttccttaggaaaccacttttagaaattaactggacaggactgacgaatcttctggatgtccctggattgaatggtttatcagatactatcattttggatataatatcaaactatctggtgcttcccaatcgaatcaccgttccacttgtcagtgaagttcaaatagctcagttgcggtttcctgtaccaaagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggctttagtgtatgaacatcctggacaagaattagagattgagctctttgatgaagacccagacaaggatgactttttaggaagtcttatgattgacctcattgaagttgaaaaggagcgccttttagatgaatggttcactctggacgaggttcccaaggggaagctacacttgagactggagtggctcacgttaatgccaaatgcgtcaaacctcgacaaggtgctaacagacatcaaagctgacaaagaccaagccaacgatggtctttcctctgcattgctgatcttgtacttggattcagcaaggaaccttccgtcagggaagaaaataagcagcaacccaaatcctgttgtccagatgtcagttgggcacaaggcccaggagagcaagattcgatacaaaaccaatgaacctgtgtgggaggaaaacttcactttcttcattcacaatcccaagcgccaggaccttgaagttgaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaacgggacgaccctgggacagtctccactggggcagatccagctgaccatccggcacagctcgcagagaaacaagcttatcgtggtcgtgcatgcctgcagaaacctcattgccttctctgaagacggctctgacccctatgtccgcatgtatttattaccagacaagaggcggtcaggaaggaggaaaacacacgtgtcaaagaaaacattaaatccagtgtttgatcaaagctttgatttcagtgtttcgttaccagaagtgcagaggagaacgctcgacgttgccgtgaagaacagtggcggcttcctgtccaaagacaaagggctccttggcaaagtattggttgctctggcatctgaagaacttgccaaaggctggacccagtggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttatttta

SEQ ID NO: 428913 - DNA, 1385 bp, Homo sapiens
accgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggttcattttccagacactgaaagagcagaatggctaaataagactgtaaaacacatgtggcctttcatttgccaatttatagagaagttgtttcgagaaactatagaaccagccgtgcggggagcaaacacccaccttagcacctttagtttcacgaaggtcgacgtgggccagcagcccctcaggatcaatggtgttaaggtatacactgaaaatgtagacaaaaggcaaattattttggaccttcagattaggtaagtttttatttgttatatttgtgttatggttaatggcgtgtaatgtcacttagctgtacctgtaaggtggaggatacagtgagcacacgtcttacctgctgttgattggaattcgactaaattcttgttagacatccaaatattatttaccttctgggtctcagtttctaacagccttgatcattgccattcataaaatatgttaaataagaagttaaagacactgcaaaaaaagaaaactatggaccaatattctttatgaacattgataaaatccttaacaaaatactagcaaactgaattcggcagcatattaaaaagattttacaccatgaccaagtaggatttattcccagaatgcaaagataattcagcatacaaaaatttgtcgatgtaacacaccacattaaaaggaaggaaaaaaccaaatcgtgattatctcagttgatggagaaaaagcatttaacaaaattcaataccctttcatgataaaaacactgaatgaactaggaatagaaggaaactaactcaacataataaaaaccatataagaaaaccccacagttaacatactcagtgggccgggcgtggtggctcatgcctgtaatcccagcaatttggaaggccgaggcgggcggatcacgaggtcaggagatcaggac

SEQ ID NO: 428914 - DNA, 641 bp, Homo sapiens
tgtggacatatgttttcatttctcttgggtatgtacctacaggtggaattgctgggtcatatagtaactgtttaagcatttgatgaactgctagtttcctaagtggctgcattagtttacatttccaataccagtgtgtgagggttccaatttctaacacttattttccttttttaaaataatcatctcctgtggtttaaatgtgttccctaaattttatgtgttggaaacttcaccctcaaattcatatgttgattggaggtgggcctgtgggaggtaattaggattagataaaggtcatcagggtgaggcctccatgatgagactgttggctttgtaagaagagaaagagatttgcactgacatgcatgtgtttgcattgttttgtcatgtgatgcgtcttgccatgtcatgatacagcaggaaggccctcaccagatgccagtgccatggtcttggacttcatagcctccagaaccatgagctatgtcaacttttctttatgaattacccagtctagggctaggcacggtgactcatgcctgcaatctcaacactttgggaggccaaggcaagaagactgcttgagaacaggaattcgagacaatgtgggcaacataacaaaaccatttcgcttaaaa

SEQ ID NO: 428915 - DNA, 836 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428916 - DNA, 974 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggtgagcggccccagggctggggcccagatagcccaagaagcacagctacttgtaacttgaaaagggtggaagggagttgcaacttgaaaagggtggaagggcccatatgctgtctttccagctttatttctatccacagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428917 - DNA, 688 bp, Homo sapiens
gcgaattcactagtgattgtgagctgagatcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcgatctcagctcacaatcactagtgaattcgcgccgcctgcaggtcgacaatatgagagctcccaacgcgttgatgca

SEQ ID NO: 428918 - DNA, 595 bp, Homo sapiens
  misc_feature (589)..(589): n is a, c, g, or t
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggcaccttaaggatgtgatcctactgacagccatcgtgcaggtgctcagctgcttctctctctatgtctggtccttctggcttctggtccagcggccttactccgtggtggtgctgggcccggtcatgagcatggcacccanaccagg

SEQ ID NO: 428919 - DNA, 1143 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428920 - DNA, 1056 bp, Homo sapiens
gcgaattcactagtgattgtgagctgagatcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428921 - DNA, 1566 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgtaagtgcctacctccttgcttctatgcccacttatagtcagttccctagtcctcagccctgcttggtgacgaggagtggtacccgaaaaagctctagaagagagctccagtcaaaaagaaatgagagatctgggcacagagaaagtgctaactagtaaaacacaaagaaaatgaaggcgtgagtcgtagctgaatttgagagctcttcctacctccaagtacacaaaggcttctttcctgggctgagttgggtgtcagaggagagtgggtatttgggattcagggagcagggccctttcttcaaccctgtaagaacaaccttgctcctcccacagcctggcctaattcttggtcagagttgagggagacccatggtttggaggtaacttctgaccccaacctgatcctgtgattgcttgcaggccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428922 - DNA, 1646 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgtaagtgcctacctccttgcttctatgcccacttatagtcagttccctagtcctcagccctgcttggtgacgaggagtggtacccgaaaaagctctagaagagagctccagtcaaaaagaaatgagagatctgggcacagagaaagtgctaactagtaaaacacaaagaaaatgaaggcgtgagtcgtagctgaatttgagagctcttcctacctccaagtacacaaaggcttctttcctgggctgagttgggtgtcagaggagagtgggtatttgggattcagggagcagggccctttcttcaaccctgtaagaacaaccttgctcctcccacagcctggcctaattcttggtcagagttgagggagacccatggtttggaggtaacttctgaccccaacctgatcctgtgattgcttgcaggccatttactgccttgtgacgttggtcttcttttactcatctgcctcattttgggcctgggtaagtatctccatcctgggaggtggatgagtgcgtagggtcagtggctggcctttgataccctcattcttgctctgcagttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428923 - DNA, 911 bp, Homo sapiens
cgactctgacggactccccgaacccacctcatctgcctctattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428924 - DNA, 904 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428925 - DNA, 1196 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgggcgagcaagaggcgattgatcctagctgcgggtgctggagagatggcgtcagccctaggcagaatggactggaggatgggtggacatcccagggattttgctaggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagtgagtgtcccccaccgccagcccaggtgagcggccccagggctggggcccagatagcccaagaagcacagctacttgtaacttgaaaagggtggaagggagttgcaacttgaaaagggtggaagggcccatatgctgtctttccagctttatttctatccacagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428926 - DNA, 810 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428927 - DNA, 1260 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428928 - DNA, 927 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428929 - DNA, 1788 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgggcgagcaagaggcgattgatcctagctgcgggtgctggagagatggcgtcagccctaggcagaatggactggaggatgggtggacatcccagggattttgctaggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgtaagtgcctacctccttgcttctatgcccacttatagtcagttccctagtcctcagccctgcttggtgacgaggagtggtacccgaaaaagctctagaagagagctccagtcaaaaagaaatgagagatctgggcacagagaaagtgctaactagtaaaacacaaagaaaatgaaggcgtgagtcgtagctgaatttgagagctcttcctacctccaagtacacaaaggcttctttcctgggctgagttgggtgtcagaggagagtgggtatttgggattcagggagcagggccctttcttcaaccctgtaagaacaaccttgctcctcccacagcctggcctaattcttggtcagagttgagggagacccatggtttggaggtaacttctgaccccaacctgatcctgtgattgcttgcaggccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgaaaaaaaaaaaaaaaaaaaaaaaaaaaaaaaaaaaaaaaaaaaaaaaaaagggggggggggttaaaattatcatcccggagggggccccatgttatggcgatccccccgggttttggtgaaagagagggacccatatagggagggtgattaaaaagggaggagcgaggggccagtaaaaacagcgtcggtcgtcggaacaatggtagcgggattctgtggagagaacgatcttcgggccgtgaaatatgggacaactactagagatttaggctgaggaaattaatgaggttaaagtgtaaaagattggggcaagatggtcgggtgttgcagtc

SEQ ID NO: 428930 - DNA, 775 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcgatctcagctcacaatcactagtgaattcgcgccgcctgcaggtcgacaatatgagagctcccaacgcgttgatgca

SEQ ID NO: 428931 - DNA, 1021 bp, Homo sapiens
ccgtcgcaaaagcgggacgacttcggtctgcgccggaagtgcatgagctgccgatgtggtgcttagtgattgcggtttcggtcgctctcccgtgtttcccgggctgggtatttgcctcgcaccatggcggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtg

SEQ ID NO: 428932 - DNA, 2898 bp, Homo sapiens
ttacaggcatgagccactgcgcccagccaacaccatttgttgaaagcactcttgcaaaaagcagttgactttactcatttgaggctatttctggattttctactttgttccactgatacttgtctatcccttcaccagtaccacactgtcttgattattgtagctatatataataagtcttgaaatttggtggtgatccctctcgctattctttttgtcagaattgttttagctattctaaattcctttgtcttttcatataaagtttagactaaccttccctggatctgcaaaacatcttgtagagattttgatagaaatggtgttatatctgtatatcaatttggtggcaattgacagctttactaattctttcaacacgtgaatacagagaatcttccatttatttaggtcttctttgatatcttttatcagtattttgttgttttcagcatacggttcctgtatgtgttttgttagatttacacgtatttctttttgttgttcttgtttttaggttttattttgcttcgtttttgtttttaacagagatgggggtcttgctttgttgcccaggctggtcttgaactcctggcctcaagtgatcctccggccttggtctcccaaaatgctgggattacaggagtgagccactgagctcggcctcttttttttttttttttttgagtgattgtaagtggtattgtattgtattccttttcttttcttttcctttcttttcttttcctttcctttcctttccttttttttttttttttttttgaggtggagtcttgctctgtcacctaggctggactgagcagtggctcagtcttggctcactgcaacctccacctcctgggttcatgtaattctcctgcctcagccacctgagtagcagggactacaggtgcttgccaccagcccagccaatttttgtatttttagtagagaggaggtttcaacagttgcccaggctagtcttgaactcctgggctcaagtgatccatcttcctcggcctcccaaagtgctgggactacaggcatgagccaccacgcccagcctggtgttgtattttaaatttcagtttacatgtgttcgttgttagtatacagaagtacaattgaatcttgtgtgttaattttgtatcccaggaccttgctaaactcttttatttggtctaggagtttatttgtagattctttgggattttctagtagaccatcgtgccatctataaataggaaccgttttatttcttctcttctgatctgtgtgactccccctcttttcttgcctactgtgctggctaggtcttccagtaccatctttaatagtgttgggagagtgaagttccttgcctttttctgcatcatgaatttgtatatttttacatttttctcaagacaaaaatccagtccttttatcccctgttgctcactatttactgtgactttttctattttaagtgggttttaaaggaggcttttcctgatgccagtttcccttgggaaatgaagggcctcttcctgtatcctcgccccttccctccccgttttcctggctttttaagggcatggactttgacgccccctagtggccgcgtggagccacgtctcctctcgcccctaggggagaagcgtggactggggacgtggggggacccggggacggctccatcctcctttccccatccctacccccaccccagtgtctcctgaggcacagggtccccacgggccgggctgaccccctgccccctggtgtctgcagacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428933 - DNA, 3353 bp, Homo sapiens
  misc_feature (2380)..(2380): n is a, c, g, or t
ttacaggcatgagccactgcgcccagccaacaccatttgttgaaagcactcttgcaaaaagcagttgactttactcatttgaggctatttctggattttctactttgttccactgatacttgtctatcccttcaccagtaccacactgtcttgattattgtagctatatataataagtcttgaaatttggtggtgatccctctcgctattctttttgtcagaattgttttagctattctaaattcctttgtcttttcatataaagtttagactaaccttccctggatctgcaaaacatcttgtagagattttgatagaaatggtgttatatctgtatatcaatttggtggcaattgacagctttactaattctttcaacacgtgaatacagagaatcttccatttatttaggtcttctttgatatcttttatcagtattttgttgttttcagcatacggttcctgtatgtgttttgttagatttacacgtatttctttttgttgttcttgtttttaggttttattttgcttcgtttttgtttttaacagagatgggggtcttgctttgttgcccaggctggtcttgaactcctggcctcaagtgatcctccggccttggtctcccaaaatgctgggattacaggagtgagccactgagctcggcctcttttttttttttttttttgagtgattgtaagtggtattgtattgtattccttttcttttcttttcctttcttttcttttcctttcctttcctttccttttttttttttttttttttgaggtggagtcttgctctgtcacctaggctggactgagcagtggctcagtcttggctcactgcaacctccacctcctgggttcatgtaattctcctgcctcagccacctgagtagcagggactacaggtgcttgccaccagcccagccaatttttgtatttttagtagagaggaggtttcaacagttgcccaggctagtcttgaactcctgggctcaagtgatccatcttcctcggcctcccaaagtgctgggactacaggcatgagccaccacgcccagcctggtgttgtattttaaatttcagtttacatgtgttcgttgttagtatacagaagtacaattgaatcttgtgtgttaattttgtatcccaggaccttgctaaactcttttatttggtctaggagtttatttgtagattctttgggattttctagtagaccatcgtgccatctataaataggaaccgttttatttcttctcttctgatctgtgtgactccccctcttttcttgcctactgtgctggctaggtcttccagtaccatctttaatagtgttgggagagtgaagttccttgcctttttctgcatcatgaatttgtatatttttacatttttctcaagacaaaaatccagtccttttatcccctgttgctcactatttactgtgactttttctattttaagtgggttttaaaggaggcttttcctgatgccagtttcccttgggaaatgaagggcctcttcctgtatcctcgccccttccctccccgttttcctggctttttaagggcatggactttgacgccccctagtggccgcgtggagccacgtctcctctcgcccctaggggagaagcgtggactggggacgtggggggacccggggacggctccatcctcctttccccatccctacccccaccccagtgtctcctgaggcacagggtccccacgggccgggctgaccccctgccccctggtgtctgcagacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggtagggcgcgggggctgggtgggaagaggagctcgagctgcacgcgctctcccgccaggcctcagagctcagagggcccgtccacagtaaggaaggtgcagagcgggcctcctaaccccagcggccaggctcttgcccccagtccctcctccccgagacccgggcggggctggtgctgggttgcgcagggccctccactggcctctccgtgggcttccgtcgctcggaggagcctcccttccccacctgcccttcgctgcccagggcatctagcttccaggcgacggtgtagacagccgacgccagggaagcccatgcctttgtgaatggtacagtggagtgtttcggagtgcagccccaggccagggttgaaatcctgactcacctgcttcctaactatgaggcctagagtgtttcctccccggtaaatggggtaaccttggtgccngccatgcagagctgtgtccctggcaccctgtaggttcctggagtatcaggaggaaaacaacaggttggaagagggatctgtgcctagggtgggccagggacactgactctggggccctgcctcccccgggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggtgagtagccaggcccgggcagcctctccgtctcaccccagccatgtccccaggacagctcactgtccctcctgccaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggtaggctggtggccgcgccagggagggactgccgggtggtgggagggctcaggtctttgggcagcttgcttaccccacctgagcctcagcatcctcttcctaaggttgctgtgagggttcagtaagacggtgttcatagggctgggtgcggtgactcacgtctgtaatcccagtgctttgagaggccaaagcaggaggatcacttaagtccaggagcacgagaccagcctgggcaatgtgaaaccctctttccacaaaaaaactaaaaaattagccaagcgtggtggtgcacacctgtagtcctagctactcaggaggctgaggtgggaggactaattgagcctgggaggtcaaggatgcagtgagctatgatcgtgccactgcactccagcctgggcaacagagagagaccctgtctcc

SEQ ID NO: 428934 - DNA, 1438 bp, Homo sapiens
agcggatctccccaggagacgggcgcaccttccccaagcgcggccagacctgcgtggtgcactacaccgggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428935 - DNA, 1489 bp, Homo sapiens
cccttcccacggctgccttagtacagaatcttataagtcctcctccttcagaggctacaaatggtgttccgaggccaggggagtttaaagctcgatttcacccgcgcagcctccaatccgggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428936 - DNA, 758 bp, Homo sapiens
aatatagcaagttacaagcaagggttccccgttgggatttggtaaacccaggaaagctcaaggagtgttaacagtggcacgaatcatagttaatacgggacagcaacggggctactcatccataccagaacgtgtgtaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428937 - DNA, 1467 bp, Homo sapiens
  misc_feature (4)..(4): n is a, c, g, or t
  misc_feature (6)..(8): n is a, c, g, or t
ggangnnngctgagagacagggctacgtttcagggagggaaacagattcagcagcggcagcagctggagaaggtcgtggagcagcaccttgcctgcagggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428938 - DNA, 1409 bp, Homo sapiens
ctcaacactgggtcagaagtcacggccagacaagaaacggggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428939 - DNA, 1392 bp, Homo sapiens
  misc_feature (4)..(4): n is a, c, g, or t
  misc_feature (6)..(8): n is a, c, g, or t
ggangnnngctgagagacagggctacgtttcagggagggaaacagattcagcagcggcagcagctggagaaggtcgtggagcagcaccttgcctgcagggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcatggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactggagggcagggcaggcagggggggcttcccgccctcctgcagcaaagggcaaccacccttggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttggcttgacttgctctttgtcacagactgcataagttgtcagccttgactatcttttgaataaagatttgattttaaacaaaaaaaag

SEQ ID NO: 428940 - DNA, 1123 bp, Homo sapiens
ttacagccaatcagggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaaaaaaaaa

SEQ ID NO: 428941 - DNA, 1264 bp, Homo sapiens
ttacagccaatcagggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaaaaaaaaagtggggtatgggctgggtacggtggctcacacttataatcctagtgctttgggaggttgatgtgagaggatcacttgagctcaggaatttgagaccaatgggggcaacatagtgagaccttctctctcttacaatttaatt

SEQ ID NO: 428942 - DNA, 831 bp, Homo sapiens
ttacagccaatcagggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatg

SEQ ID NO: 428943 - DNA, 475 bp, Homo sapiens
tggccttatataaggtctttttaatcttgtgttaaaatatatctctgcacacctacttataatgaatattcttgaaagattgattcattgaagtgaaatatctggaaggatcacctttttaagcagcttttgaaatgactaatgcccaggtcccacactgcggagattctgatttcattttttggactggggtactagcattggttttaagaaatcagaagatgattctcttgtgcagtggttacagaatgttgcattaatcagtgctctgttactgctgacaaaaaccctacttgaactaatttaagcaaaaagatgaatttatataaaggatgtggggtatgggctgggtacggtggctcacacttataatcctagtgctttgggaggttgatgtgagaggatcacttgagctcaggaatttgagaccaatgggggcaacatagtgagaccttctctctcttacaatttaatt

SEQ ID NO: 428944 - DNA, 1993 bp, Homo sapiens
ttacagccaatcagggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaaaaaaaaacaaaaaaaaaaaacaaaaaacaaaaaaaaaaaacaaaaaaaaaaaaaaaaaaaaacaacaaaaaccaacaaacaaaacaaaaaagaaaaaaaaaacaaaacaacaaaaaacacaaaagcagaggggggggggcggcggccgcaaacacaacaaccagcggaggggcgcgcgacacaccactccgaacaccaaatgtcagcggatgaggacggagcgcccacacttaataagagagattatcaataaaactcaggtggcgcaacgcaaccgagcctaacaatacaagaaagtataggaagagaggaaaaagaatacatgtagcggtgaggattctatacatagacaaccacatgttgtttgggtgagcgacacgacagggaggaccaaccgaaccagaacaacacaagatggaacgaccggccagaagaacgtaccgcagtgatagtggtgatcgagtaatataaccgcagatggtacgaccgatagacagaaaagagcaataatcgaggtaataatacacaaaaattaaaagaagacagaaaaaatataacagaggacacgagcgcagagagcaccacacaggaaagagcgacagagagaaaaccgaggagggggagacggaaggacagaggcggcacgaaaggaacaacaaagacccacacgcaccagagagccccgacacaagcagacggaacgcacaccacagacagaagtaagcaagcgacagacaaaaggagaagcaacgaaacgcacaccacgagcagaacgaaggacaaaaacgaagagaaacggagacacgacacacacgagcgtagcgaagcagcaagcacaaaacacgccgacaaaatacgaggccatcagtaaaacgct

SEQ ID NO: 428945 - DNA, 1359 bp, Homo sapiens
gggctgggaactggggaggcatggctgagttcggcctccaaaggcggtctttcgtctttctctcccgagtctctccgagagtgcggtctctccgagagcgcggaggcctcggggtggacagcctggaggagggggctctaagcgtggcagtctcggggcttcctccgtgttgggacgccgagccggagtggaggttgggagacctggcgtctagtccccgcgccgctgtttttctaagctgtgtggccttgggcgagtcatttgccctctccggctctttgtaacatgagagtagccctccctgcccttccttcttctgggagcagttatgaaacagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaaaaaaaaa

SEQ ID NO: 428946 - DNA, 1067 bp, Homo sapiens
gggctgggaactggggaggcatggctgagttcggcctccaaaggcggtctttcgtctttctctcccgagtctctccgagagtgcggtctctccgagagcgcggaggcctcggggtggacagcctggaggagggggctctaagcgtggcagtctcggggcttcctccgtgttgggacgccgagccggagtggaggttgggagacctggcgtctagtccccgcgccgctgtttttctaagctgtgtggccttgggcgagtcatttgccctctccggctctttgtaacatgagagtagccctccctgcccttccttcttctgggagcagttatgaaacagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatg

SEQ ID NO: 428947 - DNA, 1261 bp, Homo sapiens
ttacagccaatcagggacagagtcggtggcttcttcccggaggagaccggaagttggtttcggctgcagaggggaaggcggctaccagtgtaaagccagagctgaggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaaaaaaaaaagttttcgtctttgaaaaggggatttagcatttgctttaagaatgatagataaatggatattaagctctctacatgtaaaactatgaaatctttagacttattccattaaaaattttgcttaagctccaaaaagtagca

SEQ ID NO: 428948 - DNA, 3578 bp, Homo sapiens
cactcctgggaggctcaaaggctcaaacgccattggcagaatccccgacagctcatcctccgccccctgcagggggcggtaatgacagagtcctaatttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428949 - DNA, 3632 bp, Homo sapiens
cactcctgggaggctcaaaggctcaaacgccattggcagaatccccgacagctcatcctccgccccctgcagggggcggtaatgacagagtcctaatttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgaaaacgcatcttcatcggaaaacgcatcttcatcgccgaaacgcatctggccgca

SEQ ID NO: 428950 - DNA, 3400 bp, Homo sapiens
caccactccctaatctcaagttcccaggacacaaaacactgcggaaggcggcagggccccctgcctaggaaagccaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428951 - DNA, 2503 bp, Homo sapiens
cactcctgggaggctcaaaggctcaaacgccattggcagaatccccgacagctcatcctccgccccctgcagggggcggtaatgacagagtcctaatttccggttccggcagtaccggtagcccagtcgagatggaggaagatgcgaccggcagacggcattcgctgggaacgacggatagactgggggctgcggcctagaggtccgggcttggagttcgcctcagacgcggcttctatcgaggctatgtggcttcactgcttacctatatcccaaacagtgctgtctggtggcccttctatcacttctatgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacatggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428952 - DNA, 340 bp, Homo sapiens
ttcttacgagaggccttcatgaggcccaaggccctcttctgccatcagctgtctgaaggtcaggatgatggagtcttgccctcaactgcacacgggttcgtatgacaatcccatggcacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428953 - DNA, 7299 bp, Homo sapiens
  misc_feature (1082)..(1082): n is a, c, g, or t
  misc_feature (1621)..(1621): n is a, c, g, or t
  misc_feature (1645)..(1645): n is a, c, g, or t
  misc_feature (1662)..(1662): n is a, c, g, or t
  misc_feature (1777)..(1777): n is a, c, g, or t
  misc_feature (1783)..(1783): n is a, c, g, or t
  misc_feature (1804)..(1804): n is a, c, g, or t
  misc_feature (2702)..(2702): n is a, c, g, or t
  misc_feature (2719)..(2719): n is a, c, g, or t
  misc_feature (2729)..(2729): n is a, c, g, or t
  misc_feature (2839)..(2839): n is a, c, g, or t
gtacaaggagagtagaggtggagaggaggaggcatatgcccctgggcctatttgtccctttccattggtagggtcaatagtgagagctctgcctctaacatttcacttgattacttcaggacaaagtgctcactaattctgcgtcacctgttaggtcccttgaggaagcacgtcaacatttgtgcctgagcagtgttaaaaagtggaagaaaatccggaattggagccatgcacatgagggtctgagaaagagccctaaagaagttgggctgactaagttgggagaagggaaggctggaggaactttgcatacaggtatctgcaaagaggattttttcagagggtaaaacaagaagaatgggattgatatttccgcagaagtttggaagttatgtaacagagcaggttgagatcctaccttttaggagcagcctgccccttttgaaggggtaaagggagtgggtgcagtgccctctcttctgttgtagtggcttatccctctaaggcatgacccttggataggggttacctgcctcggaaagtccccacttccttgtgggagtttaaaatagattggcatatgtgagagatggagacaaggtgggaaatcggatcctgtcttaggatttctcatcaggagatgctgatacttggtgtttcagcttgataaattgagaaggtgccatgaaaccaggtcctggaacagaatccctggttgctctgtcttttagctgctctgaccctctgccctgcagagcatgcattttgcatgtgcctggcaggaggccctcctgcttgagccctgctgtatttgtctgtgttgacaacgtgactgccagccattaagcttggtcagtccacagacacactaggaaagcagaggcagctcttggtttctctggaacagagctgcaagaagtctctgggcatctgcatggccaggagcttatgcttaactgttgagtgacctgcagccataagggcattaattctgccttccagaggtgggaatgacttggctttaaacagtgatttgtgtgagaattcttcaaatcccataaggtagaaggcatggtggagtngaggagaaatcttggctcatatctgcctcttccattgaccagctgtgtgaccttgggcctgttacttttaacctacctgaccctccatttcctcatttatcagaagtgtctaactgtacacaagttaaactgtaaggattacatgaggtagtagtcaatcctggtgtttctctgtatcttctcacttctcactggtgttggaaatatgatcttgcgaccctagatggcagccactctggggcagaagagacagtgaccaccttttgaagagctcaaaggagaatattgccccacagggcttagtgggtcccccaggctgaggctggggaggagggccacctttgcctacagcaagtggcatatcattgttctaggggttctcttgacggcagaactttgcctctagctcattttccacagcctagattttccaatcttgccaatccagttgacttctgtcttctcatttccaagccattgttctctctctttcactatctacatggattatccttcattcaaactgctttgtcccggcngggtgcggtggctcatgcctgtantcctagcactttgggangccgaggcgggtggatcacgaggtcaggagatcgagaccatcctggctaacatggtgaaaccccgtctctactaaaattaaaaaaattagccgggcgtggtggcaggcgcctgtngtcccngctacttgggaggctgaggcnggagaatggcatgaacccgggaggtggagcttgcagtgggtggagatcgcgccactgcactccagcctgggcgacagagcgagactccgtctgaaaaaaaaaacaaaaaaactgctttgtcctgtaggaatcctgtgcgggttatgtgcacctccctcaatccttaccttgaagctaaggtttcccctcagctctcaagtactcagtttgcactgcaggtagtccctattttaacgaaagttatacggtccagctcagggaatcctgaaaagctgcccttgcttccatggtaatcaaaaggcagttctcatggaataaaagctacctgaagcctgagttgggacctttggctggggaaggtggttgaggacgttctctgattagatgcttggcatgaggtttgctactggaactgctagtgtagaatgtttcagccccctagagttgtccctgtgatgtggctacctcctttctctgggatttctcttaaagtctggggagcccctgcttctcatttcctggaatttatcttcccagtctccctttctggctgaaaatttctagtatcttacagaacagcggtgggatacactggagcacatcatattaccactaagtatgtctaataaatgatgtcctctgatttgacatttcctaaatgtgaagctcctgattttatacaattttgaaattagtaagcttgttagttttgtttgaaattctaggcattggatacacttaacatgagggctacatgtgcatcaacatactctggtttccttccctctgtatcttttttttttttgagatggagtctcactgtctcctaggctggagtgcagtggtgtgatcatggctcactgcagccccaaccttcagggctcaggtgatcctcccncctcagccacccaagtngctgggaccncaggtgcatgccaccatgcctggctaacttatttttatatattgtagagacggagtctccctatgttgcctaggctgaccttgagctcttgggctcaggtgatcctcccnccttggcctcccaaagtgttgggattataggcgtgagccactgtgtccagccttttcctctgtatcttgtatccattccccagagcgatactgtgtatccttgaacagacggtttcttgaagtcagagtctatctcctctgtcacttctcccccttcattatctaagactgaggttgtggtttatatgcttagagttgaaagcatggggtccaacgtgttctgtactctgtagttccccagactcttccagggaaactacttagctctcaggtggttcttttctgtttttctcagagcaagttatctaataactgaagaggactctgccctttggcctgttcctgactttctaactccttttgctggaggaaggggaggttgaggggggtgccctgtggtgtgaaagccccacttgccctctcctctatactttcttccaatgcagacgggagaaagtatcataaatgtagtgactgtgggtcaggggagctctgagaggccagcacaggaaaccagaaacaaaatgagtcagttcgtaggtggcgatcagaggcaccctgctgagggtgcaaggccacaggtgatgcctcctcagtaggcccaggagcatcaaaacgggaacagtccctttcagccttcaggagcctcccaaatgtcacttagtgatgtcccattcacctgcttaaaggccctgcatcctgccaggtagttggtttgtccatagcatcctgagctctgcttgggtgagccagacaaaaagaatgattcctggccagagtagtgataccagggcccagacagaggcagagagtccggatagaagatcctgtaagctggggtagggagccgaggaggccatggagccaggggaatcattgaagtgagggacaatttctggaggagggaaactgagtaaggaaggcctggccaaggaccaagaaggggacagtatcctgatctatgaaagaagactcaagtggggattgacagagccagattgggtggagtccaagctttgggcaggtgagtgtccaggagatgagggctgagaatgggccttcagagcccagccagaaggggaaagcacaaagctccaccctccttcttcacatccctccatactgctcaaatcccaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428954 - DNA, 3450 bp, Homo sapiens
cactcctgggaggctcaaaggctcaaacgccattggcagaatccccgacagctcatcctccgccccctgcagggggcggtaatgacagagtcctaatttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428955 - DNA, 2777 bp, Homo sapiens
ttgggaaagccacctggtagaagcagcaagcacagtgagggcagaccggtggtgctttgtgtctttagccattgtctttccctggattccagagcagctctcctacctgtgtcctaaggagtgccctcacattgtctttcaagctgtctcggggcccctggctgcagccactgcctccatcctcaccaatcccatggatgtcatacgaacccgtgtgcaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccagttccctgtcccttcagtctcaggagccctaggagagtctaagctggggcatcccctggcccagaggactcccgtggtgggcacagttctaagtggatcaggctgtcttgggtgcactggacttggagcactaccttgagaagtcaggttgagaaagtagttgatctagaaggcaacaagtgggcatgtgttccccagcacattacccaggccagcagagccaaacctaggagagggcagtgggtagattctctgccccaggcagccatgacatacacataaataccccaatcactcagacttacggcaacaagtgttgtctcactatggtgatctctaagatccacatcactggatgcgtagtcatcccagtcatggtaccctgtggaggaatgctggaagaacataaagagcagttcagaaagtcacccaataccaggaccactgcatttaccagcctgatactgccaagattatctgatgctctcctcaggagctaggagaggagtgctccttcctccctaccgctactctccccaagcctgtgttgcaggtagagaggtgcagcaaatagagaaggcatgtcaaaccctgcatttctacctgagacgtgtgacctggatgatcctccaaaccctattggtcccaccccctgggaaaggccatggtgccagtttgaaaggtgctagctacctgaagccttgatatttcttcatggctgccgcacattcttccaccttggccagaacaggttctgaaaaccacttctctaccttcaccaccaccactgcccatcttgatctctttgagggttttcccatttcacttgatcttatttttgtttatcccttcctgcactttgtcaagagagtcctccagtttctatccaggaatgttcacatccaaagggttggacccacggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccga

SEQ ID NO: 428956 - DNA, 981 bp, Homo sapiens
cactcctgggaggctcaaaggctcaaacgccattggcagaatccccgacagctcatcctccgccccctgcagggggcggtaatgacagagtcctaatttccggttccggcagtaccggtagcccagtcgagatggaggaagatgcgaccggcagacggcattcgctgggaacgacggatagactgggggctgcggcctagaggtccgggcttggagttcgcctcagacgcggtggagccgccggagtctgagaaggtcttcaggcaccatggaggacaaacgcaacatccagatcatcgagtgggaacacctggacaagaagaagttctacgtgtttggtgtggcaatgacaatgatgatccgtgtcagtgtctacccattcaccctcatccgcacccggttgcaagttcagaaggggaagagcctctaccatgggaccttcgatgccttcatcaagatcctgcgagcagatggtatcactggcctctaccgagggttcctggtcaataccttcaccctcatctctggccagtgttatgtcaccacttatgagctcacccggaagtttgtagctgactacagccagagtaacacagtcaaatcactggtggctggtggctcagcctcccttgtggcccagagcatcacagtgcccattgatgtagtctcccagcacctgatgatgcaacgcaagggtgagaaaatgggccgctttcaggtgcgggggaacccagagggacaaggggtagttgcctttggccaaaccaaggacatcatcaggcagatcctgcaggctgatggacttcgcggcttctatcgaggctatgtggcttcactgcttacctatatcccaaacagtgctgtctggtggcccttctatcacttctatgcaggtaagcaggggccaggacagtgggggaggaaggtgggatttctaatggggctgagatactgttgctttgtgcatgttagagtggaggt

SEQ ID NO: 428957 - DNA, 722 bp, Homo sapiens
  misc_feature (7)..(8): n is a, c, g, or t
gtagtcnnggaggagggacctacaaagactggaaactattcttagctccgtcactgactccaagttcatcccctctgtctttcagtttgggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgaggtctagctcattctgagctatttggatttacagttgcagggattgatttgtagctgacttagagaaaaacctagctttcctagtgaccaagataactgagagcaattgcttacttttggctggaattaagaacaaactagcacagaaaatagtaatctggatgttttccatctcagggggcctctagtaggtgaaaaggggcttctaaccttcaagttaagccacagaaggctgatgagattgtg

SEQ ID NO: 428958 - DNA, 3896 bp, Homo sapiens
  misc_feature (7)..(8): n is a, c, g, or t
gtagtcnnggaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgctatt

SEQ ID NO: 428959 - DNA, 3684 bp, Homo sapiens
  misc_feature (7)..(8): n is a, c, g, or t
gtagtcnnggaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggtttggtgtcagagtttctgcaaattaaaaaagagcttaatctttagtaatactcattggattcaaagtctaatgagaggctttgtgatggtatactatggtgtacataaatgttgtcgagtggtttttaatctttgtttgcaatactttcaacatcatcaatggccttgaatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactc

SEQ ID NO: 428960 - DNA, 2361 bp, Homo sapiens
ttagaaggtcaatgacctcgcgatcacctgcctcggacccccataatctgtccagcgtttctctcaagtcccctcttttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactc

SEQ ID NO: 428961 - DNA, 1010 bp, Homo sapiens
  misc_feature (7)..(8): n is a, c, g, or t
gtagtcnnggaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggtaaattttaaaggttagtttttaatgtaatattgtagctgaaatctttgaaataaagagttttttttttctttttaaaaaatataattcaataggaatgggcaaaatattgcagaagtgagtgtgcttaaatagttcaggaatttttgttc

SEQ ID NO: 428962 - DNA, 501 bp, Homo sapiens
attgtctgacttattttaacagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaaggtaagaagaaatttggaaggaaatagatgaaaattacacaattaaaatagacacaagtggccgggcacagtggctcatgcctgtaatcctagcactttgggaggccaaggcaggcagatcacttgaggccaggagtttgagaccagcctggccaacatgaggaaaccccatctctactaaaaatataaaaatcagctgggtgtggtggcacacacctgtaatcccagcagcttgggaggctgaggtatgaaaatcacttgaacctagaaggcagaggttacagcgagcccagattgcaccactc

SEQ ID NO: 428963 - DNA, 2058 bp, Homo sapiens
  misc_feature (1965)..(1965): n is a, c, g, or t
  misc_feature (1971)..(1971): n is a, c, g, or t
  misc_feature (2033)..(2033): n is a, c, g, or t
  misc_feature (2057)..(2057): n is a, c, g, or t
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattccaaattctggaagcacgtgaggtaccaaatgcctgtgccaagcaaaattcccagaaaggcctctagtttgactcccttggctgcccagaagcaatagtgcctgctgtgatgtgcaaaggnatctgngtttgaagctttcctgacttctcctagctggcttatgcccctgcactgaagtgtgaggagcnggaatattaaagggattcaggccnc

SEQ ID NO: 428964 - DNA, 3514 bp, Homo sapiens
  misc_feature (7)..(8): n is a, c, g, or t
gtagtcnnggaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactc

SEQ ID NO: 428965 - DNA, 2026 bp, Homo sapiens
  misc_feature (7)..(8): n is a, c, g, or t
  misc_feature (1933)..(1933): n is a, c, g, or t
  misc_feature (1939)..(1939): n is a, c, g, or t
  misc_feature (2001)..(2001): n is a, c, g, or t
  misc_feature (2025)..(2025): n is a, c, g, or t
gtagtcnnggaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattccaaattctggaagcacgtgaggtaccaaatgcctgtgccaagcaaaattcccagaaaggcctctagtttgactcccttggctgcccagaagcaatagtgcctgctgtgatgtgcaaaggnatctgngtttgaagctttcctgacttctcctagctggcttatgcccctgcactgaagtgtgaggagcnggaatattaaagggattcaggccnc

SEQ ID NO: 428966 - DNA, 166 bp, Homo sapiens
cagggcgcacaagtcatttttggtcattgataatgtgatgactgaggacgcaggtgattacacctgtaaatttatacacaatgaaaatggagccaattatagtgtgacggcgaccaggtccttcacggtcaagggtaagctactgacattaatgagatagaatact

SEQ ID NO: 428967 - DNA, 987 bp, Homo sapiens
  misc_feature (881)..(881): n is a, c, g, or t
  misc_feature (896)..(896): n is a, c, g, or t
taggctagtacgaggctggtgtgaatcggccgagggaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagcgggccccccgttccttgggcnggtctgggggggggnctccccggaacggcggctaggaaaaccgggcggccgggaaggcaaccggggcccgggcgccgcgggggggggcacgcccccgtgggggcca

SEQ ID NO: 428968 - DNA, 2292 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaaaaaaaaaaaaaaaaaaaaaaaaaaaaaaaaaaaaaaaaaaaaaaaaaaaaaaaaaaaaaaataaaaaaagaaacaaaaacacagcaaaaagagaaatgaacaatagacaacagaccacagcacaaccacacaaacactagactaaaacaaaggaagggcgggcgggggccgtaacacgaacaccgaccgccggggggaggccagaaagcaacgacacccacccgaacatgtggtagaaagcagagccaccaccccaagtgggaaccaacataaaacacaccgcacgagcacgaacgcgccaccaccacaacaacaaccagaccggcgcacagagagacaaaaacacgcatgaaaactagagagacgaacgttgcgagagacacagacaccccacacgaggggggggagcagacagaactaacgagaacacccgcacacccggaagaagaagaagccgagcgcgcggagacaaaacgagacaaaacatacagagaggaacgcagagaaccacacaaaacagaaacagacgaacggcacgaaagcagactcgccgcggagaaacaaaacacaaaccg

SEQ ID NO: 428969 - DNA, 1781 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaaaacacaccatcgccacgccacacaacaacaacaaaaacaacaaggggcgccccaaaaaaccccc

SEQ ID NO: 428970 - DNA, 1958 bp, Homo sapiens
ggatatagaaggaagcaaacgaggcctttgcttacctgcgggagtcgttctgaccgttcatgccacgtgagagggttttgttaacgttagtttttggcttaggtcctttaaggtcttgaacatcggtttcctgacttgagcggggcccatgcccctgccgaggaggctcagcctggaagcagctagcccatttcctatctcccccaccacgaccccagcaaggatctctacttgacttacctccttcaggcaaccacctagaaaatcgttgagtttgttcatgtcacaagtgaaagtattttttcatgcattcatcgttggcacgtcgtcctttggcaatattaaaatctaccaacaaatgggaaaagttaacatttgcaccatcttgccatattcaaaaaccttgtgcttaagtgttttgaaaagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428971 - DNA, 1423 bp, Homo sapiens
  misc_feature (13)..(13): n is a, c, g, or t
  misc_feature (16)..(16): n is a, c, g, or t
  misc_feature (23)..(24): n is a, c, g, or t
ccagctggtacgnccnggggtanngatatcgtcgacccacgcgtcgctgggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428972 - DNA, 1812 bp, Homo sapiens
ctatgaacgagcgaggagtgaggtggcccagaggatctaaagaaagcaaccaggtacaggccaggcgcggtggctcaggcctgtaattccagtacttagggaggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtaagtggcctcaggacctggttgcagaggggctggggctcccatgatgtccagcactgggctctgatcacccctgaggacacagtgcaccccaggacctttgacacctgggggtctgaggggccccagttttaatggcttgtggacttgcagactgtttcctcccccactctcactgtgtctttctgtgttacaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428973 - DNA, 1285 bp, Homo sapiens
  misc_feature (1179)..(1179): n is a, c, g, or t
  misc_feature (1194)..(1194): n is a, c, g, or t
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagcgggccccccgttccttgggcnggtctgggggggggnctccccggaacggcggctaggaaaaccgggcggccgggaaggcaaccggggcccgggcgccgcgggggggggcacgcccccgtgggggcca

SEQ ID NO: 428974 - DNA, 1404 bp, Homo sapiens
  misc_feature (1309)..(1309): n is a, c, g, or t
  misc_feature (1320)..(1320): n is a, c, g, or t
  misc_feature (1326)..(1327): n is a, c, g, or t
  misc_feature (1345)..(1345): n is a, c, g, or t
  misc_feature (1364)..(1364): n is a, c, g, or t
  misc_feature (1373)..(1373): n is a, c, g, or t
  misc_feature (1380)..(1380): n is a, c, g, or t
ctatgaacgagcgaggagtgaggtggcccagaggatctaaagaaagcaaccaggtacaggccaggcgcggtggctcaggcctgtaattccagtacttagggaggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtaagtggcctcaggacctggttgcagaggggctggggctcccatgatgtccagcactgggctctgatcacccctgaggacacagtgcaccccaggacctttgacacctgggggtctgaggggccccagttttaatggcttgtggacttgcagactgtttcctcccccactctcactgtgtctttctgtgttacaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagcgtcctattggacagctatggggggtgtgcacgcccggggacctggcggtctcaganaacgggctggnccggtnngagcaacgggggccggtngtcagaggggggggggacngcccctggntgggggncccattggaatggcccgtggtagg

SEQ ID NO: 428975 - DNA, 1844 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctgggagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428976 - DNA, 1748 bp, Homo sapiens
ctatgaacgagcgaggagtgaggtggcccagaggatctaaagaaagcaaccaggtacaggccaggcgcggtggctcaggcctgtaattccagtacttagggaggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtaagtggcctcaggacctggttgcagaggggctggggctcccatgatgtccagcactgggctctgatcacccctgaggacacagtgcaccccaggacctttgacacctgggggtctgaggggccccagttttaatggcttgtggacttgcagactgtttcctcccccactctcactgtgtctttctgtgttacaggtgcagcttcaagcttaggaccacccaccatgcctatccagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428977 - DNA, 1647 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttggtgagaaggcagatgtagacagcatccctccagacactctgctgtttcctgcctaggcgtggctgcagccatggctaggaaagcgctgccacccacccacctgggccagagctggttctgctcctgcttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428978 - DNA, 1569 bp, Homo sapiens
ctatgaacgagcgaggagtgaggtggcccagaggatctaaagaaagcaaccaggtacaggccaggcgcggtggctcaggcctgtaattccagtacttagggaggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtaagtggcctcaggacctggttgcagaggggctggggctcccatgatgtccagcactgggctctgatcacccctgaggacacagtgcaccccaggacctttgacacctgggggtctgaggggccccagttttaatggcttgtggacttgcagactgtttcctcccccactctcactgtgtctttctgtgttacaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428979 - DNA, 1717 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428980 - DNA, 1878 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctgggagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428981 - DNA, 1419 bp, Homo sapiens
taggctagtacgaggctggtgtgaatcggccgagggaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428982 - DNA, 1309 bp, Homo sapiens
  misc_feature (1214)..(1214): n is a, c, g, or t
  misc_feature (1225)..(1225): n is a, c, g, or t
  misc_feature (1231)..(1232): n is a, c, g, or t
  misc_feature (1250)..(1250): n is a, c, g, or t
  misc_feature (1269)..(1269): n is a, c, g, or t
  misc_feature (1278)..(1278): n is a, c, g, or t
  misc_feature (1285)..(1285): n is a, c, g, or t
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagcgtcctattggacagctatggggggtgtgcacgcccggggacctggcggtctcaganaacgggctggnccggtnngagcaacgggggccggtngtcagaggggggggggacngcccctggntgggggncccattggaatggcccgtggtagg

SEQ ID NO: 428983 - DNA, 1980 bp, Homo sapiens
ggatatagaaggaagcaaacgaggcctttgcttacctgcgggagtcgttctgaccgttcatgccacgtgagagggttttgttaacgttagtttttggcttaggtcctttaaggtcttgaacatcggtttcctgacttgagcggggcccatgcccctgccgaggaggctcagcctggaagcagctagcccatttcctatctcccccaccacgaccccagcaaggatctctacttgacttacctccttcaggcaaccacctagaaaatcgttgagtttgttcatgtcacaagtgaaagtattttttcatgcattcatcgttggcacgtcgtcctttggcaatattaaaatctaccaacaaatgggaaaagttaacatttgcaccatcttgccatattcaaaaaccttgtgcttaagtgttttgaaaagacagggtttcaccatattggccaggctggtctcgaactcctgacttcgtgatctgcccacctcggcttcccaaagtgctgaggttgcaggcgtgagccaccgtgcccggccgcgtttcctactctttaagctctgttagcttggcctctgtccctgaaggtgcagcttcaagcttaggaccacccaccatgcctatccaggtgctgaagggcctgaccatcactcattaagaacagaggaggctgcctgttactcctggtgttggtgagaaggcagatgtagacagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428984 - DNA, 2052 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttggtgagaaggcagatgtagacaggtgcccagcaagtgctgagccaggcgctgccctaagcactgggctcattaaccttagtaaccctgttggggggcggaggtgggatgggggctggggctgggttgcagtgagatgtccagtgtccagggttcttgaaagggctgcacttggggaccccgtgatgtccagcactgggctctgactgcccctgaggacacggtgcaccccgggacctttgacatccggggttctgaggggccccactccgggaggtgatggtgggggtgtggctgtttcccccattcgtgccttttctgtgtccttcccctgacagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428985 - DNA, 2011 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttggtgagaaggcagatgtagacaggtgcccagcaagtgctgagccaggcgctgccctaagcactgggctcattaaccttagtaaccctgttggggggcggaggtgggatgggggctggggctgggttgcagtgagatgtccagtgtccaggcactgggctctgactgcccctgaggacacggtgcaccccgggacctttgacatccggggttctgaggggccccactccgggaggtgatggtgggggtgtggctgtttcccccattcgtgccttttctgtgtccttcccctgacagcatccctccagacactctgctgtttcctgcctaggcgtggctgcagccatggctaggaaagcgctgccacccacccacctgggccagagctggttctgctcctgctgcagggacactgagctggctatctcggcgcttcgggcaagaactgcaacaggctctcctgggtcctgcaggtgtacagccgggcccctgccttgtgcctcagctctcgagagctgctgctgccgggtgacctgatccaacctgataaggtgccatcttcagctaccactgcaaggccctgagggcaacagcagcacggcactgcccacccggctgctgatggcctggtgccagctgggagtcctcccggcacttcgaggccactgagccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428986 - DNA, 1409 bp, Homo sapiens
ctctcgtgtcgggccgccctcggggtcctttctcttcacggcccatctttgatgctgtcttcagaattgccggacgcaggggacaagacaatcgtttccatcatatccttgcccctttttgtcagccccagagacagcgtctcctcgcttgttcaggaagattctagcggaagcaggcagtattcctttccctaagcatgaaatggggtttcccaaacaggcgtgtgtattggacgcctcgggcggagcgcgggctggcgccgaggaccggccttgcgagcggcgcgcactataaaatggcgcgtgctgcaacccgcgcccgcttcggagagagaaatgctggggtgcagcttcaagcttaggaccacccaccatgcctatccaggtgctgaagggcctgaccatcactcattaagaacagaggaggctgcctgttactcctggtgttgcatccctccagacactctgctgtttcctgcctaggcgtggctgcagccatggctaggaaagcgctccacccttccagccccagcccaccatggacaggggtatccagcttcctcctcaacctcgtcctctgcccctgagccagtgacgcccaaggacatgcctgttacccaggtcctgtaccagcactagctggtcaagggcatgacagtgctggaggccgtcttggagatccaggccatcactggcagcaggctgctctccatggtgccagggcccgccaggccaccaggctcatgctgggacccaacccagtgcacaaggacttggctgctgagccacacacccaggagaaggtggataagtgggctaccaagggcttcctgcaggctaggggaggagccacccccgcttccctattgtgaccaggcctatggggaggagctgtccatacgccaccgtgagacctgggcctggctctcaaggacagacaccgcctggcctggtgctccaggggtgaagcaggccagaatcctgggggagctgctcctggtttgagctgcattcaggaagtgcgggacatggtaggggaggcaaaaagccttgggcactaccctccctgtggagctgttcggtgtccgtcgagctagccacaccctgacaccatgttcaagggtaccggaagagaagggtgtctgcccccaacctcccctgtgggtgtcactggccagatgtcatgagggaagcaggccttgtgagtggacactgaccatgagtccctggggggagtgatcccccaggcatcgtgtgccatgttgcacttctgcccaggcagcagggtgggtgggtaccatgggtgcccacccctccaccacatggggccccaaagcactgcaggccaagcagggcaaccccacacccttgacataaaagcatcttgaagcttttactccgtttttaaa

SEQ ID NO: 428987 - DNA, 600 bp, Homo sapiens
aaatgaactcaggatgtgaggtagggttcagttgttagggtgttaaattatccagtggcttggcagcctacttgttttacccgtataatataaacatgcataaaggatctctctcttcattgaggctctgcatgcaccttgaatattttacaatgcttgcctaaaagcaatcaacatgaaagcccatccttggtctttgcctaggaatacagtccctccctactcaagtgaatacatgaagcacataaacacatgcagtcagtactgggattactggcctcatctgtatgtgtagactctgctcagtgaggcagcctcacaaatcatttggcatgtccaggtgaaagactctagaaatgcaagattccaaactgtaatatacatgaaaagcaaaaaggatgctttttatccaagttctgccttgttcagatgtacaagcgacaagtctctccaggatacaagaaagtaggaggttcattgttaatgttacccggctacagacttcctgccgaacatatggctgtcatggataacgctgacctcaaggaagttctcctactgaggctgtagccttttcaaaatctattgttcttttttaaa

SEQ ID NO: 428988 - DNA, 802 bp, Homo sapiens
ttttatctgttccttaactcctctgtgtctgtttccttatgtgtgaaacaggaatgataacaatatctacttcacaggctattctgaggttgacataaaatcagtatatatgaataataagttatagtttatctctgagcaatatactattttagctgaggatgaaagttgactattttttgtaaatgtgtggccaagtttactgtgtaacttgaaagtaaataatggagtctttcactgactgtatgctgaagaaatgaactcaggatgtgaggtagggttcagttgttagggtgttaaattatccagtggcttggcagcctacttgttttacccgtataatataaacatgcataaaggatctctctcttcattgaggctctgcatgcaccttgaatattttacaatgcttgcctaaaagcaatcaacatgaaagcccatccttggtctttgcctaggaatacagtccctccctactcaagtgaatacatgaagcacataaacacatgcagtcagtactgggattactggcctcatctgtatgtgtagactctgctcagtgaggcagcctcacaaatcatttggcatgtccaggtgaaagactctagaaatgcaagattccaaactgtaatatacatgaaaagcaaaaaggatgctttttatccaagttctgccttgttcagatgtacaagcgacaagtctctccaggatacaagaaagtaggaggttcattgttaatgttacccggctacagacttcctgccgaacatatggctgtcatggataacgctgacctcaagga

SEQ ID NO: 428989 - DNA, 1837 bp, Homo sapiens
agattacctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaattcttggtctattctggattctaattttttttatgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428990 - DNA, 1678 bp, Homo sapiens
agattacctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428991 - DNA, 980 bp, Homo sapiens
tgtgttatatgaaatatcaggcctgtgttgttgttcatgtttcaagtcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcaccctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428992 - DNA, 1691 bp, Homo sapiens
ttcccgcccttgaacatcagactccaatttcttcagttctgggactctgactggcttccttgctcctcagcctgcagatggcctattgtgagacctcacgttgtcatatggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428993 - DNA, 1850 bp, Homo sapiens
ttcccgcccttgaacatcagactccaatttcttcagttctgggactctgactggcttccttgctcctcagcctgcagatggcctattgtgagacctcacgttgtcatatggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagagacagcatctcaccatgttgccaaggctggtctcaaactccggcgctcaagtgatcctcctgcttcagcctacccatgtgctggcgtgagccaccgtaggcgtgagccaccgtgcctggccaaaattcttggtctattctggattctaattttttttatgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428994 - DNA, 1082 bp, Homo sapiens
agattacctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacatgcctgtgttgttgttcatgtttcaagtcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcactgtgaataatttcctctgactgtcttcaaggccgctgactttcttcagctgtatcaagtctactgatgagcctgtcaaagaacttcttcatttctgttatttctagaaatcccatttgactctcttctggtttttacctttctaatgaaattccccatgtgttcatgaatgttagccaccttttccactaaatctgttgataaattaatcctatgtattttaaag

SEQ ID NO: 428995 - DNA, 783 bp, Homo sapiens
agattacctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacaggtatttgatatctgttttaaaagacttcaggggagtttcttctatctgaagtttgaggttaatgttattctttgtgttttgtaagatgcatacctttgtattggttagacagcatgttaggtaattatggccatcacaacttttacaattcaccagtttgtatggtaagtatacctattttttttccttttaggcaaataaagtcaacacttgtaaaaccaa

SEQ ID NO: 428996 - DNA, 1644 bp, Homo sapiens
atgtgacttgcttctccttgccttccaccatgattgtgaggcctccccagctatgtggcactggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428997 - DNA, 1741 bp, Homo sapiens
agattacctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggcaggccaccccttgtgccaccaggctcttcctccatcccaggggctccgataccctgcctttgaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcacctctaacgtaccatctaaggctgttctttcctgtgacttgacatgttttgttggatctgaagacatagcaaaggacatggaagcctggaaagatgtaaccagtggaaatgctaaaatttaccagcttccagggggtcacttttatcttctggatcctgcgaacgagaaattaatcaagaactacataatcaagtgtctagaagtatcatcgatatccaatttttagatattttccctttcacttttaaaataatcaaagtaatatcatactcttctcagttattcagatatagctcagttttattcagattggaaattacacattttctactgtcagggagattcgttacataaatatatttacgtatctggggacaaaggtcaagccagtaaagaatacttctggcagcactttgggaggccaaggcgggcggatcacgaggtcaggagatcgagaccgtcctggctaacaccgtgaaaccccatctctactaaaaatacacaaaattagctgggcgtggtggtgggcacctgtagtcccagctactcgggaggctgaggcaggagaatggtgtgaacctgggaggtggagcttgcagtgaaccgagatcgctccactgcactccagcctgggtgacagatccagactctgtctcaaaaaaaaaaaaaaaaaatacttctggcagagtcttttatcttcctattaaaatctcacttgattctcctttatgggaagtttgtcgacaaaattcatgattagtaaattatccattttttccttcagttagtttaatggtgaagatgattaacaggggaaatgcttgaagtaaatgattgtttcaatggc

SEQ ID NO: 428998 - DNA, 1056 bp, Homo sapiens
agattacctcatttcctgtgtcctctctttctttggcaatccaaagaaagtcatctttcagattgtctgctcagagttcatctcaaagcctggcaaggattggagaggtcaataagagtcagcgcctttaaaaagaaatctactcactcttctgtgtgcataaggccgagcagaggttcttcgtctcaagaggaactgacttctgttgagcactcaacacgccacagagaccagccatcttgcaacctcacctcacagcatggagagaggagaccaacctaagagaaccaggaatgaaaacattttcaactgcttatacaaaaaccctgaggcaacttttaagctgatttgctttccctggatgggaggtggctccactcattttgccaaatggggccaagatactcatgatttgctggaagtgcactccttaaggcttcctggaagagaaagcagagttgaagaacctcttgaaaatgacatctcccagttagttgatgaagttgtttgtgctctgcagccagtcatccaggataaaccatttgcattttttggccacagtatgggatcctacattgcttttaggactgcactaggtctaaaagaaaacaatcaaccagaaccattgcatttatttttgtcaagtgcaactcctgtacattcaaaggcctggcatcgcattcccaaagatgatgaattgtcagaagaacaaataagtcattaccttatggaatttggaggcacccccaagcattttgctgaagccaaggaatttgtgaaacaatgtagtcccatcataagggcagatctgaacattgttagaagttgcactgtgaataatttcctctgactgtcttcaaggccgctgactttcttcagctgtatcaagtctactgatgagcctgtcaaagaacttcttcatttctgttatttctagaaatcccatttgactctcttctggtttttacctttctaatgaaattccccatgtgttcatgaatgttagccaccttttccactaaatctgttgataaattaatcctatgtattttaaag

SEQ ID NO: 428999 - DNA, 356 bp, Homo sapiens
  misc_feature (32)..(32): n is a, c, g, or t
  misc_feature (36)..(36): n is a, c, g, or t
  misc_feature (123)..(123): n is a, c, g, or t
  misc_feature (145)..(145): n is a, c, g, or t
ctctgatctttactccatcatcactactatanctcntcctttttttcgcccccccaaaaaaacccccaaaaaaacccccccccttttttcccccccccccccaaagaaaggggaaattggggnaaaaaaagccccctttcccaanaatgggagaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429000 - DNA, 767 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaaagcgggcggaacccgggcagcaggcctaggttggggggccctcaagacagaccttagggaagggaaccgggggcaaggcccccccgtgggtcccggaaccggggaagccaaaaccaaccggaattggcccacccccgataaccttttgtggccacaaatggccaggtgcctgcctgggggcgccgaaattggcctcgtgcatgaagaaagaaacccccttcacccgtcaagcccttcaagggacgaatcttgatgggaagccccgggggattgggttgcggcctgtggttgtgttgggacacca

SEQ ID NO: 429001 - DNA, 369 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggttggcatggaaaaaggggagggagtccctcactgtcttcagtccctgaggagttcttt

SEQ ID NO: 429002 - DNA, 2482 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcagtgagtcggacaagaactgaaatgggatgggggggcaggggtttggtaggaagaggggcaggaccccactcagtcctgcctttgaccgccatccatcctctgcccccctttcccgcagatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429003 - DNA, 2395 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccagaccctgacctctagtcaattctactacccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429004 - DNA, 3076 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaaaaaaaaaaaaaaaaaaaaaaaaaaaaatttgtgtgcggcccccgcgcccggcgcccggaaaaagtttttaaaaaaccacattcgcgtgttggggcgcgcgcggggcccccagagggtataggggccacttgggcctaagcggtggtcccaaggggaacccggggccaggaacgggggtgggtttcccccccaattaaaaaaacgcgccggggggccacccggggggcgtctgggacaaaacccccagggggggacggtcgagagacggcccaatcaagggggtgtcctataacaagacgggggggtgccacaggcgagagaggctcggatataattaaaattaacccgccccgcgcagggggaaggaagagccagaccagagcgaaaacaccagacaaccaggaacagcacagacgagacaaccaaacaacacaaagcgcacacgagggacaccaacacgaaaccagcgacatcgcacccagggaccaacacagcagcccccccccaggcaagtccccaccaacgccgacatcggcacagagccgcaacaggcgcaacaacaaaatcaagacacataacacaaacacagtcaaaaactcacagcccagaacagaggcagaaacaaaccaaaacagcacgaccgaataagacaacggagcgagacgaccgacagggcaaagcgcataccaacacaggcacacaaaatgaccag

SEQ ID NO: 429005 - DNA, 2088 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429006 - DNA, 1394 bp, Homo sapiens
cgctctgtcattcaacccaggctggagtgcaatggcgcaatctcagctcactacaacctctgcctcctgggttcaagcaattctccagactcagcctcccaagtagctgggattacgggtgcctgccaccatgcccagctaatttttgtgtttttagtagaggcagggttttgccacgttggctaagcaagttttgaactcctgggattctcctctcgtcgtctcccaaagtgctggaattacaggtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429007 - DNA, 1059 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtcagagttctggccagcctggctgcccccttcccagttttccagactg

SEQ ID NO: 429008 - DNA, 760 bp, Homo sapiens
gcgagggtgaccacctcccccactgcaccccccagggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429009 - DNA, 158 bp, Homo sapiens
  misc_feature (12)..(12): n is a, c, g, or t
tgggtccaggtngtgctcgtcgtgtggaatgccgtcaccaagcactggcggtccaggaggtgcagcccatcaccagttatgacgcggcaggctccttcctcctcctgggctgcaacaacggctccatttactacgtggatgtgcagaagttccccttg

SEQ ID NO: 429010 - DNA, 2364 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429011 - DNA, 2019 bp, Homo sapiens
tatgtcccacacatggggaaatcaatcaccgtcatattttaagtgcttgctgtgtgacagccacgattacaatgactgttactctacctcttattctcactgtagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429012 - DNA, 2193 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccatctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcagcctccccaataaagtcctcactgccaa

SEQ ID NO: 429013 - DNA, 1595 bp, Homo sapiens
agcgggcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggtgcctactggctcctggccttcccaccccactgacccccttacctgacccct

SEQ ID NO: 429014 - DNA, 2087 bp, Homo sapiens
gaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttactta

SEQ ID NO: 429015 - DNA, 2119 bp, Homo sapiens
gaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttaaaaaaaaaaaaacacacacaaacaaaacaacc

SEQ ID NO: 429016 - DNA, 2322 bp, Homo sapiens
gaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttaacttacaatttcattgagatcttttgtttttcgacaaatatttttatacttactaagccagtagcagttaaaacagtgcaaaattattcttcacagtaatgttttaaaatgacagataaccaggcatggtggcttacgcctataatcctagcattttaggaggcttgggcaggaagattgcttgagcccaggagttgagaccagcctggacaacgtggtgaaaccctgtctctgt

SEQ ID NO: 429017 - DNA, 1836 bp, Homo sapiens
gaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttatatgctcatgtcaaagatgcctactgatgtaaag

SEQ ID NO: 429018 - DNA, 1858 bp, Homo sapiens
gaggtggagtctccctctgttgcccaggctggagtgcagtggcatgatctcggctcactgcaaccctccacctcctgaattaaagtgattctcctgcctcagcctcccgagtagctgggattacaggcacgcaccactacacccagataatttttgtatttttagtagagacgtgatttcaccatgttggccaggctggtctcgaactcctgacctcagctgatctgcccgccttggcctcccaaagtgctgggattacaggcgtgatccactgcacctggcctcaggtatgtttttctatctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtatgggggatcgagatcccccatacagagtaggaggcgtccttgccctattactatccatcctcatcctagcaataatccccatcctccatatatccaaacaacaaagcataatatttcgccactaagccaatcactttattgactcctagccgcagacctcctcattctaacctgaatcggaggacaaccagtaagctacccttttaccatc

SEQ ID NO: 429019 - DNA, 1158 bp, Homo sapiens
ggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgataacatggtatatgtattgttattaaagtaagtgacccatgtcaa

SEQ ID NO: 429020 - DNA, 1363 bp, Homo sapiens
  misc_feature (248)..(248): n is a, c, g, or t
  misc_feature (250)..(250): n is a, c, g, or t
gatagaatgattggtccggcgcgcgtcgcaagtaggtaggtgagtgtggatcgattagctggtctcctaggagatcctggctacatgaattagtgtgttggatagcacacacgagtgataacacagcccggcggatgaggaacatcacgaatcaatacagatggaagtctgtggtgcagtgactggtatctatcacgtaggagatcgacggcgagctgcgaagtatctaagttgacgtcactcggatnanatgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgataacatggtatatgtattgttattaaagtaagtgacccatgtcaa

SEQ ID NO: 429021 - DNA, 1367 bp, Homo sapiens
agcttgctagtagctcatacgtttggtgcgcgtagacccgagtattgttcaagtgaacaattggtcattgtagcatcgttgtaccatcaggtagtatccccgtgtccttactattagcttaggattctcggacctaataacatacaatctgcccggagcgcaaccgaagcagttcttgagatcacacctccagatagtgagttcttgatggtcatctactggtatctatctagcatggatgtccaagtcgagcaccatatcaaattcatcgccctcgtccccatgtacatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgataacatggtatatgtattgttattaaagtaagtgacccatgtcaa

SEQ ID NO: 429022 - DNA, 1104 bp, Homo sapiens
ggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgataacatggtatatgtattgttattaaagtaagtgacccatgtcaa

SEQ ID NO: 429023 - DNA, 291 bp, Homo sapiens
  misc_feature (252)..(252): n is a, c, g, or t
ggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacccgctattccaacgggtacgaatggtgcctctttagcttttcgaatgagttttgatccctgatcttcctcatgaggngaagggaacacctgtgcctgttgacaaggtgcctggggg

SEQ ID NO: 429024 - DNA, 1378 bp, Homo sapiens
ggtagggcatcgcgaagccggtcgcggtgctcagaggttaactcgactctaggcgatattcgtcacccaatcacatatgtcatacactgactccagtgtgtgtcccttcctccaatatgagagaacatcagggatccacgactcgattccgaaaagctccagagtgcacctatctcgattagcccgtttaggagatatgctgagtgctaatcgcgaagctacactaagtcgacactactgagtattaatattaaccgtcgccagagcgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttttgctgctgatatattagaataatttttaaatgtcatcttgaaatagaaatatgtattttaagcactcacgcaaaggtaaatgaacacgttttaaatgtgtgtgttgctaattttttccataagaattgtaaacattgaactgaacaaattacctataatggatttggttaatgacttatgagcaagctggtttggccagacagtatacccaaacttttatataatatacagaaggctatcacacttgtgaaattctcttgtctaatctgaatttgcattccatggtgataacatggtatatgtattgttattaaagtaagtgacccatgtcaa

SEQ ID NO: 429025 - DNA, 1056 bp, Homo sapiens
ccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgggcttggccagtcggcagt

SEQ ID NO: 429026 - DNA, 1181 bp, Homo sapiens
  misc_feature (3)..(3): n is a, c, g, or t
  misc_feature (64)..(67): n is a, c, g, or t
  misc_feature (70)..(72): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (110)..(113): n is a, c, g, or t
  misc_feature (126)..(128): n is a, c, g, or t
  misc_feature (132)..(133): n is a, c, g, or t
  misc_feature (136)..(136): n is a, c, g, or t
  misc_feature (138)..(139): n is a, c, g, or t
  misc_feature (141)..(141): n is a, c, g, or t
  misc_feature (146)..(146): n is a, c, g, or t
  misc_feature (149)..(149): n is a, c, g, or t
  misc_feature (155)..(155): n is a, c, g, or t
  misc_feature (160)..(160): n is a, c, g, or t
  misc_feature (164)..(165): n is a, c, g, or t
acncaaaaaaaaaaaaaaaaaaaaaaaaaaaaaaaaaaaaaaaaaaaaaaaaaaaaaaaaagcnnnnaannntttgctnttnggncaaaaaaaaaaaaaaaaaaaaaaannnnaaaaaaaaaaaannntgtnncanannanaaatnacnagaatngcacngacnnagcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgggcttggccagtcggcagt

SEQ ID NO: 429027 - DNA, 1201 bp, Homo sapiens
ccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgggctgatcccagctgtgtgtcaccagaagctttcccggcttctctgtgaggggtcccaccagcccagggctgatcccagctgtgtgtcaccagcagctttcccagcttctctgtgagggtcactgctgcccactgcagggtccctgaggtgaagtaaacgccggcgctgggcttggccagtcggcagtaaaaaaaaaaaaagaaaacaacgacaaaccaaccaaaagaagcacaaaaaaccacggaggggacatctaaaagggggggggcgacaacaaaggcggcgtactaagaaagggggaagcggtggccaaaacaggggtcgcggccgaa

SEQ ID NO: 429028 - DNA, 933 bp, Homo sapiens
  misc_feature (902)..(902): n is a, c, g, or t
  misc_feature (933)..(933): n is a, c, g, or t
ccccggcccacaagcccctgcagggagcgggcccgggcggcgcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggagacgcaggtgcccgcgctgctggaggccggcttccggagggagaacatccgtacggaggtgatggcgctggtcccaccggccgactgccgctactacgccttcccacagatgatcacgcccctggtgaccaaaggctgagcccccaccccggcccggccacacccatgccctcctccgtgccttcctggccgggagtccagggtgtcgcaccagccctgtgggcctgaattttccaagcttgttgttgttaanaagaaagcttttttcccgggctttctttttn

SEQ ID NO: 429029 - DNA, 1397 bp, Homo sapiens
  misc_feature (3)..(3): n is a, c, g, or t
  misc_feature (64)..(67): n is a, c, g, or t
  misc_feature (70)..(72): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (110)..(113): n is a, c, g, or t
  misc_feature (126)..(128): n is a, c, g, or t
  misc_feature (132)..(133): n is a, c, g, or t
  misc_feature (136)..(136): n is a, c, g, or t
  misc_feature (138)..(139): n is a, c, g, or t
  misc_feature (141)..(141): n is a, c, g, or t
  misc_feature (146)..(146): n is a, c, g, or t
  misc_feature (149)..(149): n is a, c, g, or t
  misc_feature (155)..(155): n is a, c, g, or t
  misc_feature (160)..(160): n is a, c, g, or t
  misc_feature (164)..(165): n is a, c, g, or t
acncaaaaaaaaaaaaaaaaaaaaaaaaaaaaaaaaaaaaaaaaaaaaaaaaaaaaaaaaagcnnnnaannntttgctnttnggncaaaaaaaaaaaaaaaaaaaaaaannnnaaaaaaaaaaaannntgtnncanannanaaatnacnagaatngcacngacnnagcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacacaaggtcatccccttgaaaggcctgtgggaggatgtggcacccaccctgcctgacggtcactttgatgggatcctgtacgacacgtacccactctcggaggagacctggcacacacaccagttcaacttcatcaagaaccacgcctttcgcctgctgaagccggggggcgtcctcacctactgcaacctcacctcctggggggagctgatgaagtccaagtactcagacatcaccatcatgtttgaggtgcgcccacctgaagttccccatgggtctccaggaagtgaccttggatgggggtgggaaggggctgctggagccaccttgctacctggggagggtcccttcctgaccccctgggtgggctggactgtgctggttcatttagaaatcaaagtcctttgcctggcgcagtggctgccaggagcagtggctcaggtctataatcccagcactgtggaaggccgaggtgggcagattgcttgagcctaggagttcaagaccagcctgggctacagagcaagacctcatctttcctaaaaaaaaaaaatacaaaaaactagctgggcgtggtggcgtgtgcctgtactcccagctacttgggaggctgaggtaggaggattgcttgggccccaggggcagaggttgcagtgagcccagatcgaaccactgcactccagcctgggtaacagagccagaccctgtctcaagaaccacgaacagaacgaaagaacagaaagaacgaaaatttaaacaacaaaacatggaaatcaggctgggcgtggtggctcacacctgtgatcccggcacttcggaaggccaaggcgggtggatcacttgagcccaggagtttgagcctagcctggccaac

SEQ ID NO: 429030 - DNA, 604 bp, Homo sapiens
  misc_feature (3)..(3): n is a, c, g, or t
  misc_feature (64)..(67): n is a, c, g, or t
  misc_feature (70)..(72): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (110)..(113): n is a, c, g, or t
  misc_feature (126)..(128): n is a, c, g, or t
  misc_feature (132)..(133): n is a, c, g, or t
  misc_feature (136)..(136): n is a, c, g, or t
  misc_feature (138)..(139): n is a, c, g, or t
  misc_feature (141)..(141): n is a, c, g, or t
  misc_feature (146)..(146): n is a, c, g, or t
  misc_feature (149)..(149): n is a, c, g, or t
  misc_feature (155)..(155): n is a, c, g, or t
  misc_feature (160)..(160): n is a, c, g, or t
  misc_feature (164)..(165): n is a, c, g, or t
acncaaaaaaaaaaaaaaaaaaaaaaaaaaaaaaaaaaaaaaaaaaaaaaaaaaaaaaaaagcnnnnaannntttgctnttnggncaaaaaaaaaaaaaaaaaaaaaaannnnaaaaaaaaaaaannntgtnncanannanaaatnacnagaatngcacngacnnagcgcgatcgaggtcgggtcgccgtccagcctgcagcatgagcgcccccagcgcgacccccatcttcgcgcccggcgagaactgcagccccgcgtggggggcggcgcccgcggcctacgacgcagcggacacgcacctgcgcatcctgggcaagccggtgatggagcgctgggagaccccctatatgcacgcgctggccgccgccgcctcctccaaagggggccgggtcctggaggtgggctttggcatggccatcgcagcgtcaaaggtgcaggaggcgcccattgatgagcattggatcatcgagtgcaatgacggcgtcttccagcggctccgggactgggccccacggcagacacagtcatcccttaaaggcctgtggaggatgtgcaccacctgctgacgtactgatgatctgtcacctacccccgagagactg

SEQ ID NO: 429031 - DNA, 2945 bp, Homo sapiens
tgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcattta

SEQ ID NO: 429032 - DNA, 3309 bp, Homo sapiens
tgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcatttaaaaaaaaaaaaaaaaaaaaaaaaaaaaaaaaaaggggggaggctaaaagattaccacctcgggggggcaacaaagtttatgggtgtacaaccgagattgttatgtaaaaaaaggggggcccaaataagagggagagtaataaatagagcaagagacggggcgcgagtaataaaaaacgcatcttgggaggtaggaaacaaatgcgatagcatgggggatattatggtgaacgaagacataacattgtgggggagaacacaatggggcaaaataccaaacagattaagggcagagaaatcaaactttaggggtagtggtgaaacaaggaattgtagcggtgaaatctgtcgcggatttgaatttg

SEQ ID NO: 429033 - DNA, 1113 bp, Homo sapiens
tcgggcgaaccaaacttacggctaggtacgaggctgggtgttgggtcggtacttcaggcgcccaggccggcggggcgcgctccggcggctcctgtcagcggcgggtgcggcggatcccagggcagccttcgggcggcggcgctgcctggtgcgtcgcggcgtggtcctccggcggctgtccggggcggtaggagttggctgcgggatgtgctcagccggggagctgctgcggggcggcgacggcggggaacgcgacgaggacggggacgcgctggcggagcgggaggcggcagggaccgagtgggatcccggggcgagcccgcggcggcgcggacagcggccgaaggagagcgagcaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaaaaaaaaacaaaaaaaaaaaacccaggggcctcaaatgccggggtccggaaaaaacgggttatgaattgcgccattggccaaaaccgtgttctctgacccaagttttcttgtcccaacggggaaaactgccggggctcacttaggggagcggataaattcgataaccccggttacctgtaattcacgaacaaggaccacgcagaaataaatcgacgactaaaaagaggacgaaaacggggacacaaacaagaaaaattttgagaagcacatttaatgcagggaaaataaacgtgtgttagtaaaaaaaaaaagaacaccgataacaaagagcagagagagtataagcacgaccaagaaaagaaagcaaacattattagcaagaaagagacgtctcgagaagagcaagcaagcgagcaacaagacacatagtacagaggcacagagccgtcaaaatagaaaataatcagcaacgaagaacacaggtactacagt

SEQ ID NO: 429034 - DNA, 2579 bp, Homo sapiens
agcgggtgcggctccgccccgacggccgggggttgggcgagccagtgacaggaggggccgggctggtacttcaggcgcccaggccggcggggcgcgctccggcggctcctgtcagcggcgggtgcggcggatcccagggcagccttcgggcggcggcgctgcctggtgcgtcgcggcgtggtcctccggcggctgtccggggcggtaggagttggctgcgggatgtgctcagccggggagctgctgcggggcggcgacggcggggaacgcgacgaggacggggacgcgctggcggagcgggaggcggcagggaccgagtgggatcccggggcgagcccgcggcggcgcggacagcggccgaaggagagcgagcaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttggtaagtaaatttatacatggatgtcacttaaaactaaactcttgatcataacagggttgaatatatattttgaatatacattagcttattcaaaactcttgtttcactactgtgatctctggtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttgaaaacatttttaaagtaatttttaatactaactatttagtatactgtcagtactgtacatctgcacactggtgttaatagggtatatattaaattatataaaga

SEQ ID NO: 429035 - DNA, 2753 bp, Homo sapiens
  misc_feature (23)..(23): n is a, c, g, or t
acggccagtacaccacggggtantgtagcgaggcctgggtggtacttcaggcgcccaggccggcggggcgcgctccggcggctcctgtcagcggcgggtgcggcggatcccagggcagccttcgggcggcggcgctgcctggtgcgtcgcggcgtggtcctccggcggctgtccggggcggtaggagttggctgcgggatgtgctcagccggggagctgctgcggggcggcgacggcggggaacgcgacgaggacggggacgcgctggcggagcgggaggcggcagggaccgagtgggatcccggggcgagcccgcggcggcgcggacagcggccgaaggagagcgagcaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttggtaagtaaatttatacatggatgtcacttaaaactaaactcttgatcataacagggttgaatatatattttgaatatacattagcttattcaaaactcttgtttcactactgtgatctctggtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttgaaaacatttttaaagtaatttttaatactaactatttagtatactgtcagtactgtacatctgcacactggtgttaatagggtatatattaaattatataaagaaataagatattttgctgttattctttctacatatattattggtcagtacatcaaataatatttggctttgatatgggaaaaaacaaactttgcctatgtaatggaaataaaatattttcttttatgaaatatattagaatgcagattatactaatatcctgaaataaaactggtaatttatttggttaaaagtataaa

SEQ ID NO: 429036 - DNA, 2777 bp, Homo sapiens
agcgggtgcggctccgccccgacggccgggggttgggcgagccagtgacaggaggggccgggctggtacttcaggcgcccaggccggcggggcgcgctccggcggctcctgtcagcggcgggtgcggcggatcccagggcagccttcgggcggcggcgctgcctggtgcgtcgcggcgtggtcctccggcggctgtccggggcggtaggagttggctgcgggatgtgctcagccggggagctgctgcggggcggcgacggcggggaacgcgacgaggacggggacgcgctggcggagcgggaggcggcagggaccgagtgggatcccggggcgagcccgcggcggcgcggacagcggccgaaggagagcgagcaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttggtaagtaaatttatacatggatgtcacttaaaactaaactcttgatcataacagggttgaatatatattttgaatatacattagcttattcaaaactcttgtttcactactgtgatctctggtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttgaaaacatttttaaagtaatttttaatactaactatttagtatactgtcagtactgtacatctgcacactggtgttaatagggtatatattaaattatataaagaaataagatattttgctgttattctttctacatatattattggtcagtacatcaaataatatttggctttgatatgggaaaaaacaaactttgcctatgtaatggaaataaaatattttcttttatgaaatatattagaatgcagattatactaatatcctgaaataaaactggtaatttatttggttaaaagtataaa

SEQ ID NO: 429037 - DNA, 2567 bp, Homo sapiens
agcgggtgcggctccgccccgacggccgggggttgggcgagccagtgacaggaggggccgggctggtacttcaggcgcccaggccggcggggcgcgctccggcggctcctgtcagcggcgggtgcggcggatcccagggcagccttcgggcggcggcgctgcctggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttggtaagtaaatttatacatggatgtcacttaaaactaaactcttgatcataacagggttgaatatatattttgaatatacattagcttattcaaaactcttgtttcactactgtgatctctggtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttgaaaacatttttaaagtaatttttaatactaactatttagtatactgtcagtactgtacatctgcacactggtgttaatagggtatatattaaattatataaagaaataagatattttgctgttattctttctacatatattattggtcagtacatcaaataatatttggctttgatatgggaaaaaacaaactttgcctatgtaatggaaataaaatattttcttttatgaaatatattagaatgcagattatactaatatcctgaaataaaactggtaatttatttggttaaaagtataaa

SEQ ID NO: 429038 - DNA, 790 bp, Homo sapiens
acaaggctgagttcctggacctgggctatgtgagtctcctctgctcctgcagatgccccctccccaccaggagcccaccctgcagaccaaagccaccaactcaggggtgggcagcctgtcacctggagcctggaccagggatctcggggctgacccccccccaactccatcatctgcaaacctgttagggtcactgttacaaggacagtgaagccaggaagggggcatgagcctacagtcccccgtggggcggagtgaccactggagtccagccgccccctctcctgtggatttggggatgggatgggggtttgtccgggtgagtcccagaagagggctggcgctgctaagggacaccaagtcaagtgccaaagacagacgtgctccgcctccatctcccctcttcctgccccctggctgccacacctccaccggcctgaggccctcctcactgccacaggagctgatggagaggctgcagggcatcgtcacgcggccgcaccacctaaggcctattcagagcagcaaggtgtgcagtggcctgggtgggccagggtcgggggccctgcagggcagtggaggccacctcatgaccccatcccgctgcccagattgccagtgaccaccgagctgaattcgcgcgctgtctggagccactgctgctgctggggccacgtcgggtggcagctgctgcaagtggtgctaacacgtgagcagcaaccggggaggccaggcacaaggtccccaacactggggtgtgggggagggtgggcgctgaggggccagatcg

SEQ ID NO: 429039 - DNA, 1707 bp, Homo sapiens
acaaggctgagttcctggacctgggctatgtgagtctcctctgctcctgcagatgccccctccccaccaggagcccaccctgcagaccaaagccaccaactcaggggtgggcagcctgtcacctggagcctggaccagggatctcggggctgacccccccccaactccatcatctgcaaacctgttagggtcactgttacaaggacagtgaagccaggaagggggcatgagcctacagtcccccgtggggcggagtgaccactggagtccagccgccccctctcctgtggatttggggatgggatgggggtttgtccgggtgagtcccagaagagggctggcgctgctaagggacaccaagtcaagtgccaaagacagacgtgctccgcctccatctcccctcttcctgccccctggctgccacacctccaccggcctgaggccctcctcactgccacaggagctgatggagaggctgcagggcatcgtcacgcggccgcaccacctaaggcctattcagagcagcaagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagcttttctctttcagatttgggaggaagcctatcagcgagtggctaatgagcaggagatttatgaaggttccagacagttggctgctgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgaggtcaggattcattgagtagaatgcccccaccaagtgcctccctctttaattagaggtcatcatggaaatggtcgggatatttacgtggtgcctggcttgagtaaaaatctgaagccagatgcttcaggattaagaccccatgctctggccttggccccacagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatc

SEQ ID NO: 429040 - DNA, 1789 bp, Homo sapiens
acaaggctgagttcctggacctgggctatgtgagtctcctctgctcctgcagatgccccctccccaccaggagcccaccctgcagaccaaagccaccaactcaggggtgggcagcctgtcacctggagcctggaccagggatctcggggctgacccccccccaactccatcatctgcaaacctgttagggtcactgttacaaggacagtgaagccaggaagggggcatgagcctacagtcccccgtggggcggagtgaccactggagtccagccgccccctctcctgtggatttggggatgggatgggggtttgtccgggtgagtcccagaagagggctggcgctgctaagggacaccaagtcaagtgccaaagacagacgtgctccgcctccatctcccctcttcctgccccctggctgccacacctccaccggcctgaggccctcctcactgccacaggagctgatggagaggctgcagggcatcgtcacgcggccgcaccacctaaggcctattcagagcagcaaggtgtgcagtggcctgggtgggccagggtcgggggccctgcagggcagtggaggccacctcatgaccccatcccgctgcccagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagcttttctctttcagatttgggaggaagcctatcagcgagtggctaatgagcaggagatttatgaaggttccagacagttggctgctgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgaggtcaggattcattgagtagaatgcccccaccaagtgcctccctctttaattagaggtcatcatggaaatggtcgggatatttacgtggtgcctggcttgagtaaaaatctgaagccagatgcttcaggattaagaccccatgctctggccttggccccacagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatc

SEQ ID NO: 429041 - DNA, 1457 bp, Homo sapiens
acaaggctgagttcctggacctgggctatgtgagtctcctctgctcctgcagatgccccctccccaccaggagcccaccctgcagaccaaagccaccaactcaggggtgggcagcctgtcacctggagcctggaccagggatctcggggctgacccccccccaactccatcatctgcaaacctgttagggtcactgttacaaggacagtgaagccaggaagggggcatgagcctacagtcccccgtggggcggagtgaccactggagtccagccgccccctctcctgtggatttggggatgggatgggggtttgtccgggtgagtcccagaagagggctggcgctgctaagggacaccaagtcaagtgccaaagacagacgtgctccgcctccatctcccctcttcctgccccctggctgccacacctccaccggcctgaggccctcctcactgccacaggagctgatggagaggctgcagggcatcgtcacgcggccgcaccacctaaggcctattcagagcagcaaggtgtgcagtggcctgggtgggccagggtcgggggccctgcagggcagtggaggccacctcatgaccccatcccgctgcccagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagcttttctctttcagatttgggaggaagcctatcagcgagtggctaatgagcaggagatttatgaagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatc

SEQ ID NO: 429042 - DNA, 1651 bp, Homo sapiens
acaaggctgagttcctggacctgggctatgtgagtctcctctgctcctgcagatgccccctccccaccaggagcccaccctgcagaccaaagccaccaactcaggggtgggcagcctgtcacctggagcctggaccagggatctcggggctgacccccccccaactccatcatctgcaaacctgttagggtcactgttacaaggacagtgaagccaggaagggggcatgagcctacagtcccccgtggggcggagtgaccactggagtccagccgccccctctcctgtggatttggggatgggatgggggtttgtccgggtgagtcccagaagagggctggcgctgctaagggacaccaagtcaagtgccaaagacagacgtgctccgcctccatctcccctcttcctgccccctggctgccacacctccaccggcctgaggccctcctcactgccacaggagctgatggagaggctgcagggcatcgtcacgcggccgcaccacctaaggcctattcagagcagcaagattgccagtgaccaccgagctgaattcgcgcgctgtctggagccactgctgctgctggggccacgtcgggtggcagctgctgcaagtggtgctaacactaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagcttttctctttcagatttgggaggaagcctatcagcgagtggctaatgagcaggagatttatgaaggttccagacagttggctgctgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgaggtcaggattcattgagtagaatgcccccaccaagtgcctccctctttaattagaggtcatcatggaaatggtcgggatatttacgtggtgcctggcttgagtaaaaatctgaagccagatgcttcaggattaagaccccatgctctggccttggccccacagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatc

SEQ ID NO: 429043 - DNA, 1422 bp, Homo sapiens
tgtgtgtccaggggccccaagaccaagagagactgggcccacacttcctctgtccagcatagaagtgaacacaccactcactcggtcctggccccggcagcattccgacggacttgctcttggccccacatcctggaacccactccagggactttaaaaaatagatgtggatgtccgggtgaggccttgcctcagccttttcaaatctcctggtggctctgctgtgctccaggtggtggagagggctgtgagatcccggagcagtccagggggctgccctgggaggctgggggaggggcagacttccccacccccctgcatccacactggctctctccccaggctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagcttttctctttcagatttgggaggaagcctatcagcgagtggctaatgagcaggagatttatgaaggttccagacagttggctgctgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgaggtcaggattcattgagtagaatgcccccaccaagtgcctccctctttaattagaggtcatcatggaaatggtcgggatatttacgtggtgcctggcttgagtaaaaatctgaagccagatgcttcaggattaagaccccatgctctggccttggccccacagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatc

SEQ ID NO: 429044 - DNA, 121 bp, Homo sapiens
gtaaagcaagtctctccactggagagtgtgcacgcgatgtggcttctgaggccaacaggacgacaaaggaaactccaggcttttcccctttggcgccagctctggggccctggctgggcct

SEQ ID NO: 429045 - DNA, 250 bp, Homo sapiens
ccaaggtgctgctggcggagggcgagaacacgcccttcgcagagcactgccgccactatgaggactcctaccgggtgagggggcagggatctgccggaggggggagatgtcctaacccactcctcaccaaggtacgctcagggaaatcgagttctcccagctgctgaagctgggagccattcctccaccaagtccatggcagtaaaaacagcctagggtgacccacgctctcacacagcctctctgtgca

SEQ ID NO: 429046 - DNA, 318 bp, Homo sapiens
cattgccaaggtgaaggagcggctggagcccaggtgaggccaagggggtgttcccagggccactgagactcttcagaatgtgcatgggggctgggtgcggtggctcacgcctgtaatcctaacacttcgggaggctgaggtgggcggataacctgaggtcagcagttcgagaccagcctggccaacatggtggaaccccatctctactaaaaatacaaaaatcagccatgcatggtggctcatgcctgtaatcccagctactggggaggctgaggcacgacaatctacagcctgggtgacacagtgagaccttgtctt

SEQ ID NO: 429047 - DNA, 226 bp, Homo sapiens
atctgagtagctagagatagcaatgccgccaccgtaaattcagctcactgccacatccaatgtccagcttttctctttcagatttgggaggaagcctatcagcgagtggctaatgagcaggagatttatgaaggttccagacagttggctgctgagtgaaccctctgtccctgagctaacccacatactagcagaggaggaagtcagagtcggccactaaccagat

SEQ ID NO: 429048 - DNA, 461 bp, Homo sapiens
accacctaaggcctattcagagcagcaaggtgtgcagtggcctgggtgggccagggtcgggggccctgcagggcagtggaggccacctcatgaccccatcccgctgcccagattgccagtgaccaccgagctgaattcgcgcgctgtctggagccactgctgctgctggggccacgtcgggtggcagctgctgcaagtggtgctaacacgtgagcagcaaccggggaggccaggcacaaggtccccaacactggggtgtgggggagggtgggcgctgaggggccagatcgccagcaagaagccaggtgccaccattccttcctccgtccttagctcgccaccctcccagcagggtgtctgggcacaggggatggccagggcgagtccactaagtaggggaacaggaagccctggacctgaagtccatggcagaccgggctcggagcttggctaaaggagga

SEQ ID NO: 429049 - DNA, 449 bp, Homo sapiens
gcggccgcaccacctaaggcctattcagagcagcaaggtgtgcagtggcctgggtgggccagggtcgggggccctgcagggcagtggaggccacctcatgaccccatcccgctgcccagattgccagtgaccaccgagctgaattcgcgcgctgtctggagccactgctgctgctggggccacgtcgggtggcagctgctgcaagtggtgctaacacgtgagcagcaaccggggaggccaggcacaaggtccccaacactggggtgtgggggagggtgggcgctgaggggccagatcgccagcaagaagccaggtgccaccattccttcctccgtccttagctcgccaccctcccagcagggtgtctgggcacaggggatggccagggcgagtccactaagtaggggaacaggaagccctggacctgaagtccatggcagaccgggctc

SEQ ID NO: 429050 - DNA, 2006 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgaacactgagggcttccattcaagggcaacaacccgggcccttaagactccgtgggaagacacctctcataagcaccgcgattacggcaacaggacgcgcgagcatatctagaggtacggccgcacccacggcacggaaccagcacgccccccacggaataagcagcaggaccccagccgcacggttacaaggatccacccgttgtacacctccttggttcgactcccgcccgc

SEQ ID NO: 429051 - DNA, 3165 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttttgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcaaacaacagaaacacaaagacaggaccacaagaatacaacaagaagagaacaagagagagaaaa

SEQ ID NO: 429052 - DNA, 3102 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttttgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttca

SEQ ID NO: 429053 - DNA, 2848 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttttgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgttta

SEQ ID NO: 429054 - DNA, 2678 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttttgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatattctattttgtatatttgctatttggg

SEQ ID NO: 429055 - DNA, 2480 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttttgtgtgtgattctggccggaatcctcggagtcacc

SEQ ID NO: 429056 - DNA, 2307 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggacacaaatcatgttagttttccttttggggtggccaaggtttcctcccatagttttaggcaat

SEQ ID NO: 429057 - DNA, 2275 bp, Homo sapiens
agtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaaatgattgtaaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatccccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagggagcgtggctttccttcatggcatgcccagagctcatcccatgctaattatccagcacttcatagacacaaatcatgttagttttcgtcgacgcggccgcgaat

SEQ ID NO: 429058 - DNA, 4159 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 429059 - DNA, 861 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacagtaagcagcttgaagcttttaatctatatataataactaagttaagtacagtaacatattttgcggatttctcaactgagaagggctggtaggtggcagagagaaactttattttacaaaatttgaccctgtaatcgtgcctttctttttaagtttgaatgtctagtaaaaatctacattggttaaagttgtat

SEQ ID NO: 429060 - DNA, 4074 bp, Homo sapiens
gattcaacagacataaaattcttgtcagtctgctataaaaatttgtaaatgcttaatctccacttataagtttgtcttgtcatgatatggtctctatcttcatctcactctttttcttcccacagtcacccaaaatgacggtatgttcctaaaatactttcccgtggaaggtgtaagttcccctcttcctggccaaatgctcaaatgttttactcccatcacctcctttgttttgcataagtatcactttctataaaaattatcatttaatgatggaaatgaacttaactgcctttaccatcagcagtctctttttatccatgataaaatttgcagagtagtttaacaggcataactcaagctgtttatttcttcttagctttatatacttacggataggaagtcatgcagtacaagtgtgcaaaagttctgcaaagtatatgttacttttgctgatcacatacaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 429061 - DNA, 3897 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctcccaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 429062 - DNA, 3895 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaagcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 429063 - DNA, 2326 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagtactcactctctctccacttttgttatttttccctacccccctctccttcatcattttcttatct

SEQ ID NO: 429064 - DNA, 327 bp, Homo sapiens
gaatgaacttcagaatttgtcaagtgcagaagttgttgtccctcgtgaccagacacctgatgagaatgaccaagtggttgtcaaaataactggtcacttctatgcttgccaggcaagtgggctctaaaataagctattgtatctttctcacgtggaagcaattctcccacaggtgctcctacctgatagaattagttaaggttgtttgatgcttaagacttttcatctcccttttagcgggtgatttcagagactactagcaaactgactagtatgtatctttaatcatcaaatggatttctatttgaaattgttgaaatgaaggag

SEQ ID NO: 429065 - DNA, 739 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggaaatggggcagccttgaggtcagacttggaattatgtcctagctccactactttctcattgtgtgatctagttatgggatctctgaacagacagggacctgcggatgcggtgatgccgactgacggacgggacctgcggatgcagtgatgccgactgacggagggggacctgcggatgcggtgatgc

SEQ ID NO: 429066 - DNA, 4318 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgcagcttgttgtgtagtatgttttatttttggttttcaattgaatgggaatgttctgaattttttttcaaactctacgcagatttctgttataccatgtccagccatggtacttaatgtgaaccttgataatactcttgcatatgaactaagaactagagcg

SEQ ID NO: 429067 - DNA, 3227 bp, Homo sapiens
tacagactccactgtgaatacacgcttactgctctcgttttcctctctgcttgcgcccactatcagaatcgatgtccaccgtaaagaaaatgcgggggctgctgagaagtcgattactatcctctctactcctgaaggcacctctgcggcttcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttatttttacctaacactaacatgagtaacctaagggaagtgctgaatggtgttggcaggggtattaaacgtgcatttttactcaactacctcaggtattcagtaatacaatgaaaagcaaaattgttccttttttttgaaaattttatatactttataatgatagaagtccaaccgttttttaaaaaataaatttaaaatttaacagcaatcagctaacaggcaaattaagatttttacttctggctggtgacagtaaagctggaaaattaatttcagggttttttgaggcttttgacacagttattagttaaatcaaatgttcaaaaatacggagcagtgcctagtatctggagagcagcactaccatttattctttcatttatagttgggaaagtttttgacggtactaacaaagtggtcgcaggagattttggaacggctggtttaaatggcttcaggagacttcagttttttgtttagctacatgattgaatgcataataaatgctttgtgcttctgactatcaatacctaaagaaagtgcatcagtgaagagatgcaagactttcaactgactggcaaaaagcaagctttagcttgtcttataggatgcttagtttgccactacacttcagaccaatgggacagtcatagatggtgtgacagtgtttaaacgcaacaaaaggctacatttccatggggccagcactgtcatgagcctcactaagctattttgaagatttttaagcactgataaattaaaaaaaaaaaattagactccaccttaagtagtaaagtataacaggatttctgtatactgtgcaatcagttctttgaaaaaaaagtcaaaagatagagaatacaagaaaagtttttgggatataatttgaatgactgtgaaaacatatgacctttgataacgaactcatttgctcactccttgacagcaaagcccagtacgtacaattgtgttgggtgtgggtggtctccaaggccacgctgctctctgaattgattttttgagttttgtttgtaagatgatcacagtcatgttacactgatctaaaggacatatatataaccctttaaaaaaaaaatcactgcctcattcttatttcaagatgaatttctatacagactagatgtttttctgaagatcaattagacattttgaaaatgatttaaagtgttttccttaatgttctctgaaaacaagtttcttttgtagttttaaccaaaaaagtgccctttttgtcactggattctcctagcattcatgatttttttttcatacaatgaattaaaattgctaaaatcatggactggctttctggttggatttcaggtaagatgtgtttaaggccagagcttttctcagtatttgatttttttccccaatatttgattttttaaaaatatacacataggtgctgcatttatatctgctggtttaaattctgtcatatttcacttctagccttttagtatggcaaatcatattttacttttacttaagcatttgtaatttggagtatctggtactagctaagaaataattctataattgagttttgtactcaccatatatggatcattcctcatgtataatgtgccccaaatgcagcttcattttccagataccttgacgcagaataaattttttcatcatttaggtgca

SEQ ID NO: 429068 - DNA, 4008 bp, Homo sapiens
aagacttaggaagactggtggatgcgtttgggttgtagctaggctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggactgcccggacgagagctgggccctcaaggccatcgaggcgctttcaggtaaaatagaactgcacgggaaacccatagaagttgagcactcggtcccaaaaaggcaaaggattcggaaacttcagatacgaaatatcccgcctcatttacagtgggaggtgctggatagtttactagtccagtatggagtggtggagagctgtgagcaagtgaacactgactcggaaactgcagttgtaaatgtaacctattccagtaaggaccaagctagacaagcactagacaaactgaatggatttcagttagagaatttcaccttgaaagtagcctatatccctgatgaaatggccgcccagcaaaaccccttgcagcagccccgaggtcgccgggggcttgggcagaggggctcctcaaggcaggggtctccaggatccgtatccaagcagaaaccatgtgatttgcctctgcgcctgctggttcccacccaatttgttggagccatcataggaaaagaaggtgccaccattcggaacatcaccaaacagacccagtctaaaatcgatgtccaccgtaaagaaaatgcgggggctgctgagaagtcgattactatcctctctactcctgaaggcacctctgcggcttgtaagtctattctggagattatgcataaggaagctcaagatataaaattcacagaagagatccccttgaagattttagctcataataactttgttggacgtcttattggtaaagaaggaagaaatcttaaaaaaattgagcaagacacagacactaaaatcacgatatctccattgcaggaattgacgctgtataatccagaacgcactattacagttaaaggcaatgttgagacatgtgccaaagctgaggaggagatcatgaagaaaatcagggagtcttatgaaaatgatattgcttctatgaatcttcaagcacatttaattcctggattaaatctgaacgccttgggtctgttcccacccacttcagggatgccacctcccacctcagggcccccttcagccatgactcctccctacccgcagtttgagcaatcagaaacggagactgttcatctgtttatcccagctctatcagtcggtgccatcatcggcaagcagggccagcacatcaagcagctttctcgctttgctggagcttcaattaagattgctccagcggaagcaccagatgctaaagtgaggatggtgattatcactggaccaccagaggctcagttcaaggctcagggaagaatttatggaaaaattaaagaagaaaactttgttagtcctaaagaagaggtgaaacttgaagctcatatcagagtgccatcctttgctgctggcagagttattggaaaaggaggcaaaacggtgaatgaacttcagaatttgtcaagtgcagaagttgttgtccctcgtgaccagacacctgatgagaatgaccaagtggttgtcaaaataactggtcacttctatgcttgccaggttgcccagagaaaaattcaggaaattctgactcaggtaaagcagcaccaacaacagaaggctctgcaaagtggaccacctcagtcaagacggaagtaaaggctcaggaaacagcccaccacagaggcagatgccaaaccaaagacagattgcttaaccaacagatgggcgctgaccccctatccagaatcacatgcacaagtttttacctagccagttgtttctgaggaccaggcaacttttgaactcctgtctctgtgagaatgtatactttatgctctctgaaatgtatgacacccagctttaaaacaaacaaacaaacaaacaaaaaaagggtgggggagggagggaaagagaagagctctgcacttccctttgttgtagtctcacagtataacagatattctaattcttcttaatattcccccataatgccagaaattggcttaatgatgctttcactaaattcatcaaatagattgctcctaaatccaattgttaaaattggatcagaataattatcacaggaacttaaatgttaagccattagcatagaaaaactgttctcagttttcattattttaccatcaaccactcaaccatgcagtcacaccctcacagggcaagtagctgcacatggatgctctgcgccagcgggctcatatcaacacgctgaccaattattacccactcccaacctcaccactaaagagttaattcccaggtcacatcacccacactagcacaacagcccaacacatatgctcgccaccttacactctctctcccacaaacaccccccagactccatccacctcgtagccatccaccactcgggcactcaaggcaaacgtacgcaacaaccaggcagcaaacacgacacacaacagatccagacatccaccaaaaccacaatcagccacaacccaggcccacaactccccagaccctcactacccagccgacccagacctgtcacaacaacacaacctcaccaaccacacagatacacccatcggcgacccatggccgaaccgcaacccaacgcacacaacccacagcccaccgcgacacccaccactcacgacacacataaaacaacaaggccgggacacaccacacacacacccggcaaccacgccctacacacacagcaacccacacgaacagcacacaaaattaacacgactacaccaacaaacactccacacaacacccacgcctacaaccaacacacaacaacacgatcaccaccgagcggcaacacagcaccacacagccaccccgaacccccaacacaaagactgacaaatacacacgttcgaggaacacacaactcagcaccacagaggaaccacacagctacaagcacacgcacatcaacgacacacgatccagccctacatcaaccacagctcatacagaacactaaacatgacaatacgggcagccacacacacagagctccaaaagcacgacaaaccgcacggaaccaatgcgaagacgacagacacaaggaacgagagaacaccgaacacagcagaacaagaaaagcctcatcacctgcgccaacagcacaccgaagagccacaaagcgagacctcatcaccatcaaacaacgacaaacacgaacaccactagccagacaccagacacccaaccaccacggcaatcatatcgcaacacagcacatcacacacagcacgacagcacgcaactgaacacactcacggacaacaactccggcacaataacacagtaacacacacggacctaactgaggacagcacaaataccaactactgcaaccaacctaaccacaacagaacacaactacaatacagccaacacaagcgacggacacacatcacgagctgcgacacacacacacaccacacttgcgcaacacgaagacacaccacagacgccgcgacaccgctggcgtacacacacaaccacgcccaacacacgcaacctcaaccaaaacagcaaacaccaacacaaagacaagagacaacaacaacagtgcaaccacaccacaaacaaacacaaacaacacacaggcacataacacgaagacaaacacactcacgtgacacac

SEQ ID NO: 429069 - DNA, 490 bp, Homo sapiens
  misc_feature (408)..(408): n is a, c, g, or t
  misc_feature (428)..(428): n is a, c, g, or t
  misc_feature (469)..(469): n is a, c, g, or t
  misc_feature (481)..(481): n is a, c, g, or t
gggagaggagggggaggggaggggagaggaattgaggagcagaacagaataacacagaaagaaccaaccagagctggaccaaaaatcgaggccaggatgttgtagagtcttgggttcaaattctgcctcctcctgggaagtcccctgagcctgctacaaggtcttggcttgcaccctattgcctctggcagatcctccaaccagcaccaatgaagcacctaccccatgcagggtccttcagaaacaaagagtgagatagcttccagtctcaggtggggaatatttagacttgtgaacaggggcaaagaaggagaggatgttcctgttccttccccaccaccaagaccttatttcccgcatttcggacctgaggccacggttttgcccagggtttaaggggccacggcnaaggaaggttggccgaacgnggtttgaacccaacgccttgggcccaacgttggggacgacntggccccaacgngttgttccg

SEQ ID NO: 429070 - DNA, 1759 bp, Homo sapiens
gggagaggagggggaggggaggggagaggaattgaggagcagaacagaataacacagaaagaaccaaccagagctggaccaaaaatcgaggccaggatgttgtagagtcttgggttcaaattctgcctcctcctgggaagtcccctgagcctgctacaaggtcttggcttgcaccctattgcctctggcagatcctccaaccagcaccaatgaagcacctaccccatgcagggtccttcagaaacaaagagtgagatagcttccagtctcaggtggggaatatttagacttgtgaacaggggcaaagaaggagagaaacaaccaggaagtaacctccaatttgcagatggggaaaattaagtttcatcaggaggaaatgactttgcctcaggcttctcttgggatcccagatttctagaggatggggggaatgtccctgctttgggcatgtttttaagagcactggaacagccagagctgctgcccacagtctgaagtcaggaggggaactccatgtcagataaaagctttggaatccagatggagtaaggtttcattttctctgcctgcatttggtttcctaacatcacaatgtgagccttggctagcagccagcttagctttggaaaagagtgaatgatggggaaaaaaaaaaaaaaagactgtgccaggaagggaggggaggagaggggctacactaggctggaggggatatgggcctggctttagaggattatgctaggaaaaggggtgccagaggttgaaagctgataggaacaagccctgtggatcaagaggcccatcagtgagcctgcagggtctatgaactccttacatgcaaaattacatgtgtctgtctgtgtaggtctctacagattggtggaagtgttcacagctttcatgagattattatttttttttttttaagaaaggcacactgccgcatgcaacacctcatttggatgtgtctggagtcttggaagttttgactaccctacattctcctacaaatggaccttgagagcttgtttggaggttctagcaggggagcgcactacttcgtatacccttgaccaaagaacagtcctcctctattggggaaggttgtcctcttctgaaactacctttgcaaaaattatagcagtgagaaaattatgacagtgaaagaaatctgacctaattgactccatcttgcttctaacctcccagctgcccttgttcattcctgggcatagggagcactaactttgggaggatttagtttatagtttaactttgaaacaaagatgataacagcccctccctgagaccaacccactccttgcctggggaccagaaagcctttgtaaaactaacacattggccacaagattagaaatgacggctcaggagtcatgcagccaaaggcctcgagatcatgaacctccccaattgctcctgtagataatattattattgtaaaacctaacatgggtgtttgaggtatttttcagaccctgccttctgatggatcagctggcaccacccagaccagtaaactggctcatctggtcttctggcccccacccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaacccctgtctcctgtttaaaaaactctact

SEQ ID NO: 429071 - DNA, 1812 bp, Homo sapiens
ggtatggctgttcctccatctctccgaacctggcttcgcctgtccctttcactccacaccctctgcgccttctgccttgagctgggactgcttgctgtctgtccggcctgcacccagcccctgcccacaaaaccccaggtacagcggtctccccagcctgccctgctcaggccttgcccccagacctgagcaagccaggcctggcttgctcaggtcttggcttgcaccctattgcctctggcagatcctccaaccagcaccaatgaagcacctaccccatgcagggtccttcagaaacaaagagtgagatagcttccagtctcaggtggggaatatttagacttgtgaacaggggcaaagaaggagagaaacaaccaggaagtaacctccaatttgcagatggggaaaattaagtttcatcaggaggaaatgactttgcctcaggcttctcttgggatcccagatttctagaggatggggggaatgtccctgctttgggcatgtttttaagagcactggaacagccagagctgctgcccacagtctgaagtcaggaggggaactccatgtcagataaaagctttggaatccagatggagtaaggtttcattttctctgcctgcatttggtttcctaacatcacaatgtgagccttggctagcagccagcttagctttggaaaagagtgaatgatggggaaaaaaaaaaaaaaagactgtgccaggaagggaggggaggagaggggctacactaggctggaggggatatgggcctggctttagaggattatgctaggaaaaggggtgccagaggttgaaagctgataggaacaagccctgtggatcaagaggcccatcagtgagcctgcagggtctatgaactccttacatgcaaaattacatgtgtctgtctgtgtaggtctctacagattggtggaagtgttcacagctttcatgagattattatttttttttttttaagaaaggcacactgccgcatgcaacacctcatttggatgtgtctggagtcttggaagttttgactaccctacattctcctacaaatggaccttgagagcttgtttggaggttctagcaggggagcgcactacttcgtatacccttgaccaaagaacagtcctcctctattggggaaggttgtcctcttctgaaactacctttgcaaaaattatagcagtgagaaaattatgacagtgaaagaaatctgacctaattgactccatcttgcttctaacctcccagctgcccttgttcattcctgggcatagggagcactaactttgggaggatttagtttatagtttaactttgaaacaaagatgataacagcccctccctgagaccaacccactccttgcctggggaccagaaagcctttgtaaaactaacacattggccacaagattagaaatgacggctcaggagtcatgcagccaaaggcctcgagatcatgaacctccccaattgctcctgtagataatattattattgtaaaacctaacatgggtgtttgaggtatttttcagaccctgccttctgatggatcagctggcaccacccagaccagtaaactggctcatctggtcttctggcccccacccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaacccctgtctcctgtttaaaaaactctact

SEQ ID NO: 429072 - DNA, 929 bp, Homo sapiens
gggagaggagggggaggggaggggagaggaattgaggagcagaacagaataacacagaaagaaccaaccagagctggaccaaaaatcgaggccaggatgttgtagagtcttgggttcaaattctgcctcctcctgggaagtcccctgagcctgctacaaggtcttggcttgcaccctattgcctctggcagatcctccaaccagcaccaatgaagcacctaccccatgcagggtccttcagaaacaaagagtgagatagcttccagtctcaggtggggaatatttagacttgtgaacaggggcaaagaaggagagaaacaaccaggaagtaacctccaatttgcagatggggaaaattaagtttcatcaggaggaaatgactttgcctcaggcttctcttgggatcccagatttctagaggatggggggaatgtccctgctttgggcatgtttttaagagcactggaacagccagagctgctgcccacagtctgaagtcaggaggggaactccatgtcagataaaagctttggaatccagatggagtaaggtttcattttctctgcctgcatttggtttcctaacatcacaatgtgagccttggctagcagccagcttagctttggaaaagagtgaatgatggggaaaaaaaaaaaaaaagactgtgccaggaagggaggggaggagaggggctacactaggctggaggggatatgggcctggcttttgggggtttttcctacagggcctgggttggcccctttttgcctttggcggttcctccacccggccccattgaggcccttcccccttgcggggtccttcagaaacaaagagggagatggcttccggtctcagggggggattttttagccttgggaccgggggcaaggagggggggaaccacccgggaggtaccctccatttgg

SEQ ID NO: 429073 - DNA, 513 bp, Homo sapiens
gggagaggagggggaggggaggggagaggaattgaggagcagaacagaataacacagaaagaaccaacccactccttgcctggggaccagaaagcctttgtaaaactaacacattggccacaagattagaaatgacggctcaggagtcatgcagccaaaggcctcgagatcatgaacctccccaattgctcctgtagataatattattattgtaaaacctaacatgggtgtttgaggtatttttcagaccctgccttctgatggatcagctggcaccacccagaccagtaaactggctcatctggtcttctggcccccacccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaacccctgtctcctgtttaaaaaactctact

SEQ ID NO: 429074 - DNA, 2138 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatggga

SEQ ID NO: 429075 - DNA, 1191 bp, Homo sapiens
agagtatgtgtgtgtgcacgggtgggggataaacaattaaaaaagccaccccaaactctgttgaaataagagctgtctgtgccttcacaggtctgcaaactggagaggatgaaagtggctttttttccctgtttgtcacttccctcacgtggctgccagcattatgcaagtgtacaggaaggcaggatttttttttttaatgcatgcatgcggattaaggtcaagcccctagtatcagccatgcagcgggctctcccttccagctgcagccgcagagcctacccacagccgcgagatgccttaattgagacgtgctgtcaaagtgacaaacacatttgcatacagtctacactctatttattttctctggaaaggtctacagtctgctgttggttgaacattcttaatcagtttgctgtaagtgaactgccagctagctcacttatgccggccccttcttcattaggtgacagattagctgcaagagggaggggggcttgagccaggggaaaccacagacccctttcttttaactctttccagctttgcccttatggtaggttgtccttgagtcttttcccgggtccctggtttgatgggctgttgaccgtaagaagtacggtttctagagcacctactaccggcaggcatgagttttaaggacttgatattcttcccaaagaacagtctcttgagtttcatttcagaagtttttaccacactctcttaccatctatactattttctttacttgatagttttctttaaataagactcagacctgacatctatagcatcttagcctcatcttcagagatgccattggtaaaattataggcttgatatactagtcccagttttttctaacatataaaacaattttaagtgttcatctatgaatcacctaatgcactcacgtagccctaatggtatatattctctttttttggaaaccaacagactccttggtatcttttttgttgtctccaccacatccctttgaggaagggaccattagccccattttattgacccagagctggagctcagagacgtgagagaacctgcccagggccgcttcaccagcttggaaacccaagcccagacacctcctctcgagcccacaccagctctcaaacaagcagggactgcagccatgtgatatgtctgttaaagctactgtaccctgcc

SEQ ID NO: 429076 - DNA, 844 bp, Homo sapiens
tccaggccgcagcccgaagtgtccacttatcatgttttctgacctgccgccctggagaatttgccgtttcctctttggactcctgtggacactttaccccccaccccaccccaccctggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacagactccttggtatcttttttgttgtctccaccacatccctttgaggaagggaccattagccccattttattgacccagagctggagctcagagacgtgagagaacctgcccagggccgcttcaccagcttggaaacccaagcccagacacctcctctcgagcccacaccagctctcaaacaagcagggactgcagccatgtgatatgtctgttaaagctactgtaccctgcc

SEQ ID NO: 429077 - DNA, 5864 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagaggctggcatccccgtgtccttgaagcttttgggtcggggaggccccacacgggcccggagccatcctcaccacctgctcctgtagaggcaggggccaggcgcagagcagttagggaaggagtcaactccccgcaccctcccaagccggtgcccactcagggctctaagccagctcatgctctgcccctcacagaccaggcacggggttgggctggcaacaggcctgctcagccctgcgggggccatggggcagactgcaggcctccaacgacgttgagggcacccaggagccaggaaagagttcaaggggacacctggcaagtcgcccccacaggtctctcattagcaagaacagagcctgggactctgcctctgttggacgctggtgtttgcggggaggcgggcgggggaatgcagaccaatcgaccaccccatagtgagcgtggaacatgcccagtcacaccacccaccccctccgactcgcccatcatctgaccatgcccccacttgcaggactgactgacaggctgaaaacgacaggcacgcgggccgggcgcggtggctcacacctgtcatcccacacctataatcccaacattttgggaggccggggcaggtggatcacgaggtcggtcaggagttcaagaccagcctggccaagatggtgaagccccgtctctactaaaagcaggcacctgtaatcccagctactccagaggctgaggcagggaattgc

SEQ ID NO: 429078 - DNA, 5076 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagttctgcagattcagattcaactttgttctgccttcatgtgcagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429079 - DNA, 4957 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429080 - DNA, 5490 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagaaaaaaaaaaaaaaaaaaaaaaaaaaaaaaaaaaaaaagggggggggggcaaaaaatttctcctgtcagggggggcaagtgttttagcggttaccccagtttttttgggtaaaagggggccccaaaagaggaggcgctgttttataaaagagcagaggaagaggggccgggtttaaaacgcgcgcgttggcgggggaaacagggctcacggggagaattttgtggaaaaaaacccctttttggggggggggcctattggggcccacacttcctaacgaaattaaggctggagcaaaataaacatttccagggttagggtagcagcaggatagttgccgtgaaattggtaggatgttggaattg

SEQ ID NO: 429081 - DNA, 2989 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429082 - DNA, 3012 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggctgtgctgaggggctggggtgagcgctccatgttcacatgagcactgctgcctcttcacttgtgggactttttgcaaacccaaggatgaactttgtgtgcattcaataaaatcatcttggggaagaaaaaaaaaaagtcgacgcggcc

SEQ ID NO: 429083 - DNA, 2286 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggcaaattttcaaaaattttgaggagacagcacggctgaggtcataaatgagcgggactgttgaatgaagtcattaaatgcactgctgcctcccgtactccaaggcactctgcttaaggtgcctctgttagctaagcatctcattagaacactttagcatcccgggcccttctttgcaccttcaaataaaaggcaacaagcgaagtcttaaaaaaaaaatcaattaggagttctttattaatgtacttcctgaaaatcaatatcaggagtcgtgcttctgagagtaaacacccgtgctacaattctagagattcaattttttaagcaactgttttcaactacctgagcattagaaaaattgtctatttaattttttttcccttaagtaaaacattccactctgtatagaaactaaaattttgtatccccttcctacttgtaattatatttttggttaaaaaagattatgtacccttt

SEQ ID NO: 429084 - DNA, 2144 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgacattgccgagaatggctgcgcccccaccccagaagagcagctgccaaagactgcaccgtccccactggtggaggccaaggaccccaagctccgagaagaccggcggccaatcacagtccactttggacaggcaaattttcaaaaattttgaggagacagcacggctgaggtcataaatgagcgggactgttgaatgaagtcattaaatgcactgctgcctcccgtactccaaggcactctgcttaaggtgcctctgttagctaagcatctcattagaacactttagcatcccgggcccttctttgcaccttcaaataaaaggcaacaagcgaagtcttaaaaaaaaaatcaattaggagttctttattaatgtacttcctgaaaatcaatatcaggagtcgtgcttctgagagtaaacacccgtgctacaattctagagattcaattttttaagcaactgttttcaactacctgagcattagaaaaattgtctatttaattttttttcccttaagtaaaacattccactctgtatagaaactaaaattttgtatccccttcctacttgtaattatatttttggttaaaaaagattatgtacccttt

SEQ ID NO: 429085 - DNA, 1156 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtggaagagagcatcgtgatccagtgagccttgccctaagcgtgtgtgtatgatt

SEQ ID NO: 429086 - DNA, 447 bp, Homo sapiens
cctggtgggaacatgagggatggattatgattgcccccttatggagagaacgctgcatggcacctgagtgcctcggactaaagattcctccttaaggggatgaaatttgtcacatttctttgaagtcccctctttaaaactggactaaaccttttagacactgtaccaggatacagggtcacaggcctgttgatattgagatgtaaacccagaatattcttgcattacacagaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagta

SEQ ID NO: 429087 - DNA, 312 bp, Homo sapiens
ccgagtccttccttgtgctcatcaacatagcagcctcagctgccccccttggatcccctgccagggctgctatcatcttctgatcaaatattaatgtgtgatcctctgcttgctcactaatccaaagccaattaatattatctgtcaattatttacagatcctgaggtgcagaggcaattcccggaggactacagtgaccaggttcggaatgcgtaattaattttttacatgacaaaatttatttcagagttgttcaacatattattactgttctttttactgaaagagataaatgaatttttagaagggaa

SEQ ID NO: 429088 - DNA, 3677 bp, Homo sapiens
tctagcagttccccaggatcaacgtccaacgaaaatcatcagggagagtacgctgagaagatgacaaaatgtaccatcagatggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429089 - DNA, 5127 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429090 - DNA, 5000 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429091 - DNA, 5073 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccagttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaag

SEQ ID NO: 429092 - DNA, 4369 bp, Homo sapiens
  misc_feature (4318)..(4318): n is a, c, g, or t
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaacgaggcatgccctgagcccttctccaggcagtagaaggacaactggtctttgctcgtgaacaggagaggctagagcagncttcaactgccaagttcagcagttctcagagttgagccagatactgacccg

SEQ ID NO: 429093 - DNA, 2179 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatgggagccagtttggtggttggcaaactaccagtgatagaaaacaa

SEQ ID NO: 429094 - DNA, 2802 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgtgcagtcatccaggacagttcctggcatggggactgtgtgcagcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcacccttcctgtgagaggcgggcaattcttattggtagctctcgatacatttttgtatcccggtttgacgtcttgtgtgttttcctgacattt

SEQ ID NO: 429095 - DNA, 1812 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacagctgcagagactgcgtccaccgaacgctccaagatacagcgctcgagccgtgcgccactcgtcacctgttgtagagaccaagagcaat

SEQ ID NO: 429096 - DNA, 1109 bp, Homo sapiens
gcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctggtaaggtggctggccctgtcctctgcttctcctttgccctgatctgactgggcgtgttaggtgtgtcacttgttaatgcagttggtgactctacattaaaaatattaacttcatccagcctggacaaaatagtgagaatccatctgtacaaaa

SEQ ID NO: 429097 - DNA, 4552 bp, Homo sapiens
aaccaaaaaaggctggaagaacatgaagatggagcagtcataaaccacccactcaaggaccatctccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcgtaagtatcctctaggtgccactgaggtaaccagtaactcgttccttgatattatatggaaatcgtttccccagaaaattttgctttttcactttttgagatgtatcccactggagtgaaatgtgtcactggatatcttgagctctgtattgaagaactgagatcagtgaaatacttgttgctaatccagaagaatctgatttttgtttattggatcaaaattttctaaatgcaaactttagttatttgaagtcaatatgttgagttgtttcattcaagtgtttataggaatccaacaaatactgctctattggatcgccaaatgttggactattttagtatcaaccgtttcccctctgtagtgacaacgtcctaaacagttaggtttataacaagtgtttactttctaacaagaaaacagaagacatttaaatgacaactttcaagaagaaaatttttattttttcagaagttggcattatcttcctggcagattgctcacatccaatattatttgtatatgctaaacaggaaacggcaacttgtttatatctctatttagatagtctttccccaaaatttccacagaaacatacagtgttcatggttcttgagttcatgaaggagtaatctaatcactccaacatggtctggaatgtttcaggtttaatccatatgcccactctcttggaggctgtccagtagcgtcaaaactttagtgttttaatacattcacctgttacttttgagatgaagttcacctttcttggatcacatgcaaaggatgtttaggtctgtgaagaaaagaatttctaggccgggtgctgtggctcacgcctgtaatcccagcactttgggaggccgagaaccactcacgaattcttgtttggtgctcttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccgtccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429098 - DNA, 566 bp, Homo sapiens
cccccaggaaaaggtattccatgattccgaatttaatccgctcactatagggaatttgccctccagggccaaaaattgggcaaaaggcctcgtgcgggttaatatcttttcttttaaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429099 - DNA, 404 bp, Homo sapiens
gacagaagcctgacatccagggcggggtgggaggtcagggagaggactctgggctccatcccaggagctgagagaagggtggaaaggtgagccccccaatcactttctggcccccagttgatccctaccctgctctattccaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429100 - DNA, 516 bp, Homo sapiens
cgagggtcacccatcaaactctccccggctacccctagtcagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaaagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429101 - DNA, 3239 bp, Homo sapiens
tagctaggaggcgggtgatcggccgaggacgatcctgttgatgccctgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccgtccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429102 - DNA, 1653 bp, Homo sapiens
  misc_feature (84)..(84): n is a, c, g, or t
acgcatgtgccgctcccgagcaggcaggcaaggtgacgggactggaagcccttttcagagccttggaggagctggtccgtccgngaagcaatgagtgccaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429103 - DNA, 4590 bp, Homo sapiens
aaccaaaaaaggctggaagaacatgaagatggagcagtcataaaccacccactcaaggaccatctccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcgtaagtatcctctaggtgccactgaggtaaccagtaactcgttccttgatattatatggaaatcgtttccccagaaaattttgctttttcactttttgagatgtatcccactggagtgaaatgtgtcactggatatcttgagctctgtattgaagaactgagatcagtgaaatacttgttgctaatccagaagaatctgatttttgtttattggatcaaaattttctaaatgcaaactttagttatttgaagtcaatatgttgagttgtttcattcaagtgtttataggaatccaacaaatactgctctattggatcgccaaatgttggactattttagtatcaaccgtttcccctctgtagtgacaacgtcctaaacagttaggtttataacaagtgtttactttctaacaagaaaacagaagacatttaaatgacaactttcaagaagaaaatttttattttttcagaagttggcattatcttcctggcagattgctcacatccaatattatttgtatatgctaaacaggaaacggcaacttgtttatatctctatttagatagtctttccccaaaatttccacagaaacatacagtgttcatggttcttgagttcatgaaggagtaatctaatcactccaacatggtctggaatgtttcaggtttaatccatatgcccactctcttggaggctgtccagtagcgtcaaaactttagtgttttaatacattcacctgttacttttgagatgaagttcacctttcttggatcacatgcaaaggatgtttaggtctgtgaagaaaagaatttctaggccgggtgctgtggctcacgcctgtaatcccagcactttgggaggccgagaaccactcacgaattcttgtttggtgctcttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccgtccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaaaaaaaaaaaaaaacaaacaaacagaaaaagacaaacaa

SEQ ID NO: 429104 - DNA, 4395 bp, Homo sapiens
aaccaaaaaaggctggaagaacatgaagatggagcagtcataaaccacccactcaaggaccatctccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcgtaagtatcctctaggtgccactgaggtaaccagtaactcgttccttgatattatatggaaatcgtttccccagaaaattttgctttttcactttttgagatgtatcccactggagtgaaatgtgtcactggatatcttgagctctgtattgaagaactgagatcagtgaaatacttgttgctaatccagaagaatctgatttttgtttattggatcaaaattttctaaatgcaaactttagttatttgaagtcaatatgttgagttgtttcattcaagtgtttataggaatccaacaaatactgctctattggatcgccaaatgttggactattttagtatcaaccgtttcccctctgtagtgacaacgtcctaaacagttaggtttataacaagtgtttactttctaacaagaaaacagaagacatttaaatgacaactttcaagaagaaaatttttattttttcagaagttggcattatcttcctggcagattgctcacatccaatattatttgtatatgctaaacaggaaacggcaacttgtttatatctctatttagatagtctttccccaaaatttccacagaaacatacagtgttcatggttcttgagttcatgaaggagtaatctaatcactccaacatggtctggaatgtttcaggtttaatccatatgcccactctcttggaggctgtccagtagcgtcaaaactttagtgttttaatacattcacctgttacttttgagatgaagttcacctttcttggatcacatgcaaaggatgtttaggtctgtgaagaaaagaatttctaggccgggtgctgtggctcacgcctgtaatcccagcactttgggaggccgagaaccactcacgaattcttgtttggtgctcttgctgaactggttgataatgcaagagatgctgatgccaccagaatagatatttatgcagaaagacgagaggaccttcgaggaggatttatgctttgctttttggatgatggagcaggaatggatccaagtgatgctgccagtgtgatccagtttgggaagtcggccaagcgaacacctgagtctactcagattgggcagtacgggaatgggttaaaatcgggctcaatgcgcattgggaaggattttatcctgttcaccaagaaggaagacaccatgacctgcctcttcctgtctcgcacgtttcatgaggaagaaggcattgatgaagtgatagtcccactgcccacctggaatgctcggacccgggaacctgtcacagacaatgtagagaaatttgccattgagacagaactcatctataagtactctccattccgcactgaggaggaagtgatgacccagtttatgaagattcctggggacagcggaacattggtgatcatcttcaatctcaaactcatggataatggagagccagaactagacataatctcaaatccaagagatatccagatggcagagacgtccccagagggcacgaagccagagcggcgctcgttccgtgcctatgccgctgtgctctatattgatccccggatgaggatcttcatccatgggcacaaggtgcagaccaagaggctctcctgctgcctgtacaagcccaggatgtacaagtacacgtcaagccgtttcaagacccgtgcggagcaggaggtgaagaaagcagagcacgtagcaaggattgctgaagagaaggcgcgggaggcagagagcaaagctcggacattagaagtacgcctaggtggagacctcacgcgggactccagggtgatgttgcgacaggtccagaacagagccatcactctgcgcagagaagccgatgtcaagaagaggatcaaggaggccaagcagcgagcacttaaagaacctaaggaactgaattttgtttttggtgtcaacattgaacaccgggatctggatggcatgttcatctacaactgtagccgactgatcaaaatgtatgagaaagtgggcccacagctggaagggggcatggcatgtggcggggttgttggggttgttgatgtgccctacctggtcctggagcctacacacaacaaacaggactttgctgatgccaaggagtaccggcacctgctccgagcaatgggggagcacctggcgcagtattggaaggatattgccatcgcccagaggggaatcatcaagttctgggatgagtttggctacctctctgccaactggaaccagcccccgtccagtgagctgcgttacaaacgccggagagctatggaaatccccaccaccatccagtgcgatttgtgtctgaaatggagaaccctccccttccagctgagttctgtggaaaaagattaccctgacacctgggtttgctccatgaaccctgatcctgaacaggaccggtgtgaggcttctgaacaaaagcagaaggttcccctgggaacattcagaaaggacatgaagacgcaggaagagaagcagaaacaactgacagagaaaattcgccagcagcaggagaagctggaggcccttcagaaaaccacacccatccgctcccaagcagacctgaagaaattgcccttggaagtgaccaccagaccttccactgaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggctacccctagtcggaagcggagtgtcgcagtttctgatgaggaagaagttgaggaggaagctgagaggaggaaggagaggtgcaagcggggcagatttgttgtgaaggaggaaaagaaggactcgaatgagctctcagacagtgctggggaagaggactcggctgacctcaagagagctcagaaagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctgggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggaattgtttacggtacttcctgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggtgcaggaggtgagcccggcagccttcctgttgcagctggaccacctggtctctcagggaggggggcctgggccctgttcctgttctcacaagaatctatccac

SEQ ID NO: 429105 - DNA, 586 bp, Homo sapiens
caacgggtcctcagctcatcatctgtgttgatgtctatgtcctcctgcaccttttgcaggagtgcctccaagtttccccatctccaagaagcagctgagtgctatgaattcagatgagctaatatcttttcctctgaaggagtacttcaagcaatatgaagtagggctccaaaacctgtgcaattcctaccagagccgtgctgactcccgggccaaggcctccgaggaaagcctgcgcacctccgagaggaagctccgcgagacggaggagaagctgcagaagctgaggaccaacatcgtggcactcctgcaaaaggtgcaggaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaa

SEQ ID NO: 429106 - DNA, 171 bp, Homo sapiens
catgttctcttctgggtttcagctgaagagaaggcgcgggaggcagagagcaaagctcggacattagaagtacgcctaggtggagacctcacgcgggactccagggtaaggtcccggcccaggcggctgttctccagcgtttctggcactaggagcccatgtcccatgagc

SEQ ID NO: 429107 - DNA, 342 bp, Homo sapiens
acagaaacatacagtgttcatggttcttgagttcatgaaggagtaatctaatcactccaacatggtctggaatgtttcaggtttaatccatatgcccactctcttggaggctgtccagtagcgtcaaaactttagtgttttaatacattcacctgttacttttgagatgaaggtaagtgttctaacattctagtacctggagaggagatgagcagctacatgaatggtccagtctctgaagaacccacttcagagtcgagagtatagacttccattatgtagtaatagtacaatggtttttagcttttgatggagaagacaacatgtttgtgatatcataat

SEQ ID NO: 429108 - DNA, 703 bp, Homo sapiens
agtagctgggaccacaggtgtgtgccattgtgcctggctaatttttaaaaagtttttttttgtagagacagtgtcttcctatgttgcctaggctggtcttgaactcttgagcttaagtaatctgcacacctcagttcttccaaagtattggaatcacaagcgtgagccactgcgcccgactttttcacttctcttaatgctctgtaaacattaatgtatttatatatgtacttagaattttaaaaaatcaattttattgagttataattaacatacagtaaaaatgctcccatcttgagtaattccatgccttttgacaagtgttctgtacccatgccacgaccaccacaatcgagagagaacatcttcatcactccagaagggctcctttgcagtgagtactccctaggagttccagcggccggtgacattgatctgttttctgtcactgtagatgagatttgtctgttatatacaatttttaaaaattaaatgatatgtatggcttcttttgcttagcataatgtttttgagcttattcatttgttgcatatatcaatactttgcttctttttaccacctgtacttcatttatggatacgttgtttatccatgtgtttatccccaatggacattgggttgtttctgattttttggttattattatgaataaagttgctatgaacattattgtataaatctt

SEQ ID NO: 429109 - DNA, 4303 bp, Homo sapiens
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429110 - DNA, 4030 bp, Homo sapiens
gctggtaccggccgaagtcttagaagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429111 - DNA, 4050 bp, Homo sapiens
gattgactctgtaggactcccccacacttcgatcgcggagaaagatctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429112 - DNA, 4084 bp, Homo sapiens
cgccaccaggccccgcccagcggccgcagccagccaggccgcgcccgggacgactgcagagcgcgggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429113 - DNA, 3996 bp, Homo sapiens
gctggtaccggccgggagtttgggatcgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429114 - DNA, 3981 bp, Homo sapiens
gctggtaccggccgaagtcttagaaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429115 - DNA, 4315 bp, Homo sapiens
aggctggagtgcagtggcaatcttggctcactgcaacctccacctcccgggttcaagccattctcctgcctcagcctctggagtagctgggattacaggcggcgccacaacgcctgattaatttttttgtatttttaatagagacggggtttcatcatgttggccacgctggtcttgaattcccgacctcaggtgatctgcctgccttggcctcccaaagtgctaggattacagaggtgagccaccgtgaccggccttcactcttcaaatgtttgcttcctgttcctgctaccctgaaccctgctgttgaggggttctagtgtctacaagggaaccgctgccaccacgaggaataacacagtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429116 - DNA, 4148 bp, Homo sapiens
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429117 - DNA, 4020 bp, Homo sapiens
cgccaccaggccccgcccagcggccgcagccagccaggccgcgcccgggacgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429118 - DNA, 3961 bp, Homo sapiens
aagatacggctaggtacgaggctgggtggtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429119 - DNA, 3965 bp, Homo sapiens
gattgactctgtaggactcccccacacttcgatcgcggagaaagatctgccgctgtcgtctttgcttcagccgcagtcgccactggctgcctgagccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429120 - DNA, 4197 bp, Homo sapiens
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429121 - DNA, 4271 bp, Homo sapiens
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429122 - DNA, 4327 bp, Homo sapiens
  misc_feature (2131)..(2131): n is a, c, g, or t
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtntgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429123 - DNA, 4249 bp, Homo sapiens
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacagcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429124 - DNA, 3096 bp, Homo sapiens
cgccaccaggccccgcccagcggccgcagccagccaggccgcgcccgggacgactgcagagcgcgggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcacttgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429125 - DNA, 2875 bp, Homo sapiens
agctcggtaccccgatgatgccgagaaccccttgatagccggttgctgtagatctcccacatcacatcccggtaccaatccttctgaaaagggccccggagctgccactcctccccggtgacgtccaccgtaacatcctccagtgtcagccattcctgggcattgatcattttcttctgttgtgggaaatggcccgcacctgggatactctgtctttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429126 - DNA, 2612 bp, Homo sapiens
gccgactcgaagcccttataaggcgcggagacgccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatataaaaaaaaaaaaaaaccaaaaaaaaaaaaaaaaaaaaaaaaaaaaaaaaaaaaaaaaaaaaaaaaaaaaaaaaactagaaaaaaaaaaaccgcaactcaagacgacagcgagagaacccagagaaagccccagcagacaagacggcggagcagccgagcgacgagaaccacacacccgaagaccccaccagcaaaacaagcacaaacaaaacgaacaggaacgagcgcacaacaaaaatcgacacgaaaaagaatcggagaaggaaaagcgacaaacacgcaagaggagcagcaaagctacagcacgagaagcacgcacaacacactgtcgaagcaaccaagagcccaacaacagacgaaccaacagaaaacacacacagtgagcgagcc

SEQ ID NO: 429127 - DNA, 2630 bp, Homo sapiens
gaattcgagctccggttccccaatcggagtgcaatccgcctgacaagtgagcctggccaacatggtgaaggcatgtctctatgttaatatacccaaattagcccgggcgtggtggcgggcgcctgtaattccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429128 - DNA, 1696 bp, Homo sapiens
gattgactctgtaggactcccccacacttcgatcgcggagaaagatctgccgctgtcgtctttgcttcagccgcagtcgccactggctgcctgagtgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaaaaaaaaaaaaaaaccaaaaaaaaaaaaaaaaaaaaaaaaaaaaaaattttgcgcccccccccccccccaaaaactttttaagaaaccccaccgcgtagggagcgaccgggaccccagaagaggtacagagcacacacgggtccaaaacggagtgtctccccacaagaggaacacccggggcacacaaacacaaagggacgagggaaaatcacacaccgaactaataaaaagaaccgcccgggaggcaaacaacagcaacggtctccgtcgacaaaaacaacccagagaagagagagcactacgagcagaccaacaataacacgggagaatcatctaaaacacggggagagacactcacacgcagacgcccccagaggaaaacccaaaagatcaatagcccccacccccttggagagaaacaaaagaacgaatcagacgcacacacaggacgacagacacagaaggacatgcacacagacagcaagaagagcagaggaccgcggacacacaagaagagacagaaagggagaagcgcagagcggaggacaacggggagcacccagacgcgccgcgacggagacacggaaggagacagccaggagacacgagcgcgcgagcaggcggacgcgacagcacaccagcgaccacggcgaacccaagagcagaccgaccaagcccggacgggccggcgtggcggacgaacggcgcagcaaccataaaacagagcataacaccagtctctcagaaaccaccaaaaccccactgagcataaagcgtaacgctatataacaaccataaaactacatacaccatccataaatgtaacacaactataaaacatcaatcatacactctcaacacaacaagacacacaccatatcaacaaaacagatacgcacccagtatacacttccccatcaaaagcaaataacagaaaatacaacatgacattaataaacgaaaacataacatataaaa

SEQ ID NO: 429129 - DNA, 1182 bp, Homo sapiens
gctggtaccggccgaagtcttagaagctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggaccggggatataacacgtccacaaccactcagggcccagtccagatggacatgatctaagtgtgaccggcctctccgtactcttcaacagtatgaacactctttccattcaacattcacctaagcagctcatttcacaaccttgtccattccgtttgaagtcgtcgattcacttgggacttacagcaatttcctattacctgagaagtatgtgt

SEQ ID NO: 429130 - DNA, 2811 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccagggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataaga

SEQ ID NO: 429131 - DNA, 2173 bp, Homo sapiens
gatttttggtggggttttccccccttttttttatggagttggccaataggattgagttggggctccagtagagaaggcagggttggtggtgggtgggggcagcctgtatcagacaaaggtaaatcagccagccaggcacccacagcctcagctcctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccagggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataaga

SEQ ID NO: 429132 - DNA, 2515 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccagggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaagggggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataaga

SEQ ID NO: 429133 - DNA, 2020 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccagggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacaagccacaccccctcctctgagctctgaatatgggacccagtgccaggagctggaagacaagggggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataaga

SEQ ID NO: 429134 - DNA, 1166 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccaggtaagtgagcggggtgcggaagaggggtaacagggccatgcctggccagtgatcaaagtgttcctggatatcagccgacctccccctacaccctagatgccctccgtccactaccccctggagggcatttgtcatgtgacggaattccatggagaattgttatttaatcacgtgctcattgtagaaaaaaaaaattaagtacaaaacgtaaaacagaggagcattggatatgacatgtaattctactccccgggggtagccaccatgactgtttcagccatgtttgaatgacactgcccttccggttgcccactgcctggactgggtggcgactccatcctctcct

SEQ ID NO: 429135 - DNA, 773 bp, Homo sapiens
gtgtgtggtgcggtgtgtgtgctggtggtggtagggtctccagggactccccgctaagcagaaggatcgggatatagggcaaggctaaaagcccagccccattgtggactgaggaagtagcttctcgcagagcagctctccagctggaagaggaggtggagggtgaggctggggagaggatggcgaacctgccctgaggtgcttgggtctgtgctggtggggtcctggtatgcaggggccaccggtcactaacactcttatgtcctggctttctgtccccgctgagctttctctcacccgcccgttttctctcctgcttcattgcctgctgcctaagccttggcccttctctcgggcagaggcaggtgctgtggcagcacctctccccaccaccggggcccctgcaggccgcctccctcctcccaggcctgctaaccctctctcttctccttctttgctgtcctgccggggatctccagtgtgtgcgggggcttaagggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggggcaggggctggcctctttgccccaattcccgctccatgccggccagagtgtagaaagccataacgcagccatcagcaccattaatgtgactctacgctgatatgctc

SEQ ID NO: 429136 - DNA, 3425 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccagggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataagaaaaaaaaaaaaaaagggggggccggtcgggatctagaaattagtagaaggagaagggcaagaaggagaagggcaagaagaagggggctccccattggaaggggccgggacgaggcctcattaaaccttcctctcccttaaccatttccggaggcatctacgggctcaccattttttgtagccacgaggttccacggacttcaggtcattagtggtcaactttcctcatatgtggtgcatcggccattaattttcctttgattccgaaatcactgtggttcgaaaccgcgctgatatggcattggaatgtggtggacaatcggatgtccgcctatggggggtttaaaaaaacacaaagggggcggctaaaaatccccggggcgcaagttacgcgaccccggtttgtgacaagggggcccagaggcgcgattaaaacaagacgagggcggggtaacacgcggcagggaaacgcacgggaagggagaaaccctcggggggacagtcagcccccaataggcgaacacaaagcagggcaacgcatcgcgggtggttacagaagtgcgcgcacgcggcgccaagagacgacacggcctcggcaagcagagacagagcaaa

SEQ ID NO: 429137 - DNA, 1336 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggaggacacctgtcaggattttgccatctcctggcacagcctgaggggagctaacaggcctctttgcagagggttagctgtgtgtgcgggggcttaagggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggggcaggggctggcctctttgccccaattcccgctccatgccggccagagtgtagaaagccataacgcagccatcagcaccattaatgtgactctacgctgatatgctccctctctcctccactgacttccccttcccggatttgtgaggtg

SEQ ID NO: 429138 - DNA, 875 bp, Homo sapiens
atcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaatgccggaggggatttgtgcagtccgattccgtactcccacccggtcacgg

SEQ ID NO: 429139 - DNA, 3516 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggaattaggaatcctgctgttaagtttctcatggttgttatttgaggactcagtgagagactccaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 429140 - DNA, 5228 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaagcgtccacccaacggcccatgatcatcttgtaaccagtgcaggaccttgtgcttctggagccattccagttgtgggaggtgatgtctcggaaaactctgccttggggactggctatagaaatgtggccagatggctttgtcatcttcccctgtctactctgtgactcttcatctggtggaaatgctgtgagggatgaaccaaatggaaactcagatttactcttcagaataatgcggatcataatacgcacacacacagcatgtagagttgctgtgtggcttaaataagtaaatgtatgcaaagcactaaaatggtgtctgtctaagtgtaaacaccaattgtgttggctattatcactattgttgttcttatctcaaatatgtgttactttctaaataactttagtgttcatagattgttaaaagacaagatgacctgaagaaaagtaagccctaaaaatccattattaacttttttctccaccactcttttcttctaaacttcactattctttgtgttttcacaaaagttgcttacttcacctggcagagatagcattacgcaggggatgattaaaatatactcacttgtacttgttggttttaaattttattatttatgaataggtaatagcatgtacactgtaaaaatctcaaaaggcaaaaaaggatatacagtaaacattaagttcctcttaccctggaccttagccatcaagttctcttccccataggcaatccctgttgcctaatttccaattcccctgcatactttaaagatcatctgtgcatctgcactcagaccactcacacgtctaaaacaaatgatagcacactacacacaaagttctgttcctttttatgctcaatgatatgttttgcatcatatttcactgccgtataaataatgctgcctcgatttttaaaataactgaacagtaatacacagtatgaatttactccaatttataatccaatccttagttaatggatattttgattttgttgttaagaatcatgcagcaatgatgtacctgttagacatgagttattaatttctcttcgaagaatcaatatgtcactacgttcaattctttgccttctacttttaaacttcacttcctcataaagcaaccttttgcgatcatctgctccaccctgactcattccaatcacctgctccaccctgactcattctgatcacctgctctgcccagactcattcccatcacctgctccaccctgacttattccaattacctgctccaccctgtctcattctccaccctgactcattccataaccatttttcccaccaaaccagtcaccccctcaccctctttaaattagctaatcggaattagtttagcttgtgtggtctaacctagccaatagatgaatgacacagcagcaggagccacgttcgtcagggataagaacaccttccccttccttgtccaggggtgtactcaccattgctccatctgtgagggcgcacccttctatagaagtaaattgccttgctgagaagaaaaaaagaaaattttatatttgagtgctatttattttgtggcaccaaaactatttataacatacctgatctttattttaaatttttgtttatttaaatattaaatatattatccacctggtattaatttgtttaaataaatgtgaggtagggttccattgctattttttaaccaggtaggttatattgactaaccttcactttgaaagtgatttgaaatacacttttcatttattaaattctcccttgtgtttaggcagtaaggcataatatttgagagtgtgggctctgcagtccagctatctgggtttgaagtttatctcctttatttgcgagtggtacaaacttgaacaaattatgtaatttgtttttctcaattccctcatgcactaagtgaggataaaaatagcaataacaccatgagattgctgataacaaaatgcaaggtaaaaattgtgtaaggcttaaaattgtgtagcctggtatacaagaggctctaaataacataagctattattgcttttctacttattattatttctggcttttgtagtctttttcccattgttgatctttctactattcacaaagcatgagtctagtatctgtagatttataaactaattaatgtaacttttcaatatgttttaatatctcatagatactgttcttcctcattacttttctattttataaatttctatttcatctgcttcataaattttgcattctcataaactaagaatcatctcctgtagttaaaaaatattgtttgtatttttgttgggagtagagtgaattaaaatatattgacttaaggagaactgacatctttataatattgaatcttcctgtttgagattggactttatgtccatattttaaagtctttgtttatgaccctaagtataattttaacgtttttatattaggcttatttctagatactttttgttaatatatcatctaactggttgttcttcatatatataatgactatgaattttttctcagtcttttttctgaattctcacatcatttgtgttatatttttaagttgattctcttgagtttttcaggtaaacaattatatcacctataaaaataatgttgccaccttaaattaagaaaatgtttttctattgtctaattgcatggactgttgcctcaggaacagtataagattgcttacaaaagccttgctttcttgttccagattttaaaaacaaggctttcaatgacaatctcgctagcaagaagctggtatacttacatacatacatacaaacagacagacacccactttctatatgtatatctagatagatttagatagacatatatgtgtgattcctgttaagatgaatctatttttggtatttaagattttaaaaatctagaatgggtattattatattgtattgaagctcttaagcatctatggaaatgaaagtatgattcttctctttcgactaattaatatgtgatccatagtattttagtaacagatttcctaatatcgaatgatctaggcattgattctagcagattatgtctatgggtattttatttaagattttgcatcagtattaataaatgaccatggtctatgggtttgcttttttgtgtgctatgtttgcagagtgtttgtagtttacaagagatttttgcaaacttctatttatgacaatatggtagattatatatctgaaaaaaaaaccttctcattacagaacatatacaaaactgctgaataaaacgaggcaaccaacattttaaatatatggttaataaggtttt

SEQ ID NO: 429141 - DNA, 3451 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 429142 - DNA, 3527 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatagtaatcagacagcagaagaggagttgatgtttttccaaaggaaatcttcattaacatttagttttcattaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 429143 - DNA, 3553 bp, Homo sapiens
  misc_feature (1211)..(1212): n is a, c, g, or t
  misc_feature (1307)..(1309): n is a, c, g, or t
  misc_feature (1347)..(1348): n is a, c, g, or t
  misc_feature (1412)..(1412): n is a, c, g, or t
  misc_feature (1422)..(1422): n is a, c, g, or t
  misc_feature (1425)..(1425): n is a, c, g, or t
  misc_feature (1427)..(1427): n is a, c, g, or t
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgcaacgcgctgttgctagcaagaggcccttcttaaacagggggttcggaaacttcgacgccaaagcttaagtacgcttggctttgaaccnnctggggccaagttttacttatactaaacatttctagatctcctcaaattttatcaccatacaatcagtggtattgttggacacatacgtgcaacnnntgcattcacttgagctgaccattgcacagacaatggcnnatttggctttaagccacaacataacactaatctcttgtcaagttaggcgtctgcaagcttcttntccaattggncanangcttacagactctcaactggggaaacaagggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 429144 - DNA, 3751 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtgaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcagggtgagtaactgctcactgaactaattgcattgctgcttatgtttccaaaattttaaagatattctagattgtttgtgaactatatagcattttgtgaaatagaagtttaatctttatttatctttagagaatggtgaagttatactctgacaggtttaggctaaaacagcagttgataaataagtgatggttaaaatgtgacatttatttaattgtagaaaattattgaaaaatcatcccataaaatgataaaaagttaatatgctgtaatatgtaatatgcaaacaaaataattaggtgcttagatgtatctgttgactaaagtttaaattataatcattaatttttttttagtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 429145 - DNA, 3589 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatttctaaaaaca

SEQ ID NO: 429146 - DNA, 1424 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcagggtgagtaactgctcactgaactaattgcattgctgcttatgtttccaaaattttaaagatattctagattgtttgtgaactatatagcattttgtgaaatagaagtttaatctttatttatctttagagaatggtgaagttatactctgacaggtttaggctaaaacagcagttgataaataagtgatggttaaaatgtgacatttatttaattgtagaaaattattgaaaaatcatcccataaaatgataaaaagttaatatgctgtaatatgtaatatgcaaacaaaataattaggtgcttagatgtatctgttgactaaagtttaaattataatcattaatttttttttagtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataagttggtgactttttcttaattaaaaatgaaagcctacttttcttttgatatcttactttaaattttagtattatcaaaagcgtatataatagtttgagtaatatttataataatttacaacaatactgttcaccttaacttgaatttgtttcatggggtatcagcttatttgaattttacatactatagaatacaatatggaaagagaaac

SEQ ID NO: 429147 - DNA, 465 bp, Homo sapiens
atagagatagggttttatatatcacaaatatctgttctgacccacggttttgctaaaagagattgtgaaatattgaaaacatagtagtttgtttttattttttcatcacctaactcaaaagaaaaacaaaaatcctgatttttaaaatatgaaactagagtatttttaattcacaggttatattttacataaaaacttttatttaaatctagatccttttaaagcattctactcagttaaggaactgttttgtttcagtttctgttttgcaacctgaaatattctttgcttttagtggtattgttggaaatagtgcaactgcattattgactaccattgaagaaatgcatttgctaagcaaaaaaatattcttcaatagcttgagtcttcatgcaagtaaattaatggacaaggtatgtttgaaaaatgtaattattaaattatgtgaatgtttcacattaaaaa

SEQ ID NO: 429148 - DNA, 3397 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagctt

SEQ ID NO: 429149 - DNA, 2452 bp, Homo sapiens
cgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactttataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacct

SEQ ID NO: 429150 - DNA, 898 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaacccgagggttccgttggcggggagatgcctttaaagcccaaaggaagtcccgggcggggcggggcatggggggcccccgcggaacacgacagggtcaaaacaacgcgcaggggagggggccaaagaaatccc

SEQ ID NO: 429151 - DNA, 2056 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429152 - DNA, 2093 bp, Homo sapiens
  misc_feature (1923)..(1923): n is a, c, g, or t
  misc_feature (1925)..(1925): n is a, c, g, or t
  misc_feature (1928)..(1928): n is a, c, g, or t
  misc_feature (1936)..(1936): n is a, c, g, or t
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctaaaaaaaaaaananaanacaaaaanaaaacacgcgagagaaacaaactgaggtgtgcgggcaaaccggttctaatggccccggcatctaagtggtaccggacacacgtcttggaaacagggaaatttcgcggcacccataggagtcgaatattgcgaacccaggtacgcggatagagaccaa

SEQ ID NO: 429153 - DNA, 2049 bp, Homo sapiens
  misc_feature (1879)..(1879): n is a, c, g, or t
  misc_feature (1881)..(1881): n is a, c, g, or t
  misc_feature (1884)..(1884): n is a, c, g, or t
  misc_feature (1892)..(1892): n is a, c, g, or t
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctgtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctaaaaaaaaaaananaanacaaaaanaaaacacgcgagagaaacaaactgaggtgtgcgggcaaaccggttctaatggccccggcatctaagtggtaccggacacacgtcttggaaacagggaaatttcgcggcacccataggagtcgaatattgcgaacccaggtacgcggatagagaccaa

SEQ ID NO: 429154 - DNA, 1914 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429155 - DNA, 1767 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccaggaccccaggacccgactcgcctttagggatcctctaaacgacgcagcac

SEQ ID NO: 429156 - DNA, 1956 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429157 - DNA, 1986 bp, Homo sapiens
ctcgtgccagacccctggggctgggcaggcggaaagaggtctgaactgcctctgcctccttggtctccggcagggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429158 - DNA, 1324 bp, Homo sapiens
actgtccgtctctgattgtccaactattcaccccttcagctgtgactgttccctccattttttcagccccgattaccagttttgagtcccacccaccgtcctcattattcaactttctgaccacccatctgatggtgacggtccgtgttcctaatcccccaccaccaccatcagcctcccacccctctgtgcgcctcactgtccgtctgtccatccacccccagatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429159 - DNA, 769 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgagcggagtggagggcagcag

SEQ ID NO: 429160 - DNA, 651 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcagtgagttggggaccgggggctcgctcagatccttcgtctgcgtttccctggtgtgatgcccacacgcacctgggctgatcaggtgggatgagaagcagagagagaaagccacttactttttagttttgccttcaagtcttctgattgttggaaggaaggagagagggactccgcgggtgttggtgtctcagggcagaagacccggatacagagggttgttgtgagaatgaataacaattgttcgcacatgttga

SEQ ID NO: 429161 - DNA, 576 bp, Homo sapiens
ctgtggttggggggagtggggcggggcctgagtggttccgggtagagtgggtggggcctgctgccctgcaacgctagacgcctcctcgctgtctgcccccagaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429162 - DNA, 2012 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctgtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429163 - DNA, 1999 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429164 - DNA, 1947 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429165 - DNA, 2217 bp, Homo sapiens
ttcggtcctccggatggagttgccgggtccgcctcgctggggtcggccccctcccttcgggggcgaggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatgttgctgggagctcaactggaatgtaaaagttcttcgggaaggtgaaggtcaggcacgccgagggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429166 - DNA, 1973 bp, Homo sapiens
tcggggaggaggtggctccagagatggcagtgagcgagaggagggggctcggccgcgggagccccgcggagtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429167 - DNA, 1407 bp, Homo sapiens
ttcggtcctccggatggagttgccgggtccgcctcgctggggtcggccccctcccttcgggggcgaggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatgttgctgggagctcaactggaatgtaaaagttcttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacagggaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggcttacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaaaa

SEQ ID NO: 429168 - DNA, 270 bp, Homo sapiens
acctcatctgctgtggtgccatcctgttccccgtagtctggtgaggaccctgcccccgggctgaggctctgccctgtgcacatgggcgatgtccgcgctgaccgtaccctgtgtcctccacttgtcccaggtccatccggcatctccaggatgcgtctggcacagacgggaagggtgaggccctgcgcctgcaggccctctgctcatggccccattcctcctccgggcccttctttctgccccttggatgcccctcctggcctctctgcc

SEQ ID NO: 429169 - DNA, 449 bp, Homo sapiens
gttgtacgtgtgatgacttagtggtacagagaaataagggggtctaggtttctagtagatcaactggtagctgtagaaaaggaagatggcagaaaatgatagtggttaggtagtcaagatctaggactttctgaagcccttagaaaagcaaaaaagcaacaaactagaataagaaatattctctttgaggaccagtaaagcattgtggttaagggtgcagttgttgcaaccagactacacaggtttgaatcttggctctactatttactagctggattgggtaagctacttccctttgctggctcacatctgtaaaatgggtatggtaggagttgactgcactgggttgcttggaggagttaatgagctaatccgcataatgtgcttagaaccttgcccgataccaagtaagaggcctacaaatcttatctgtcaccatcaggtggtca

SEQ ID NO: 429170 - DNA, 6583 bp, Homo sapiens
cttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429171 - DNA, 3643 bp, Homo sapiens
tgtgaaaggacaaagttcagagcttgatatacacaccctatgataccaggcaattggtaatggttttccattacccacatgtacctctttcttttctttttcccttctcctgttgccctttctttatttcctcttttaccctcttactccctttattcttttcccttgttttcttctccactgcctgtgtcttaggcctgccagtgacacccaggcattgcttagccctgccctccacccttcaagtggggaatgaacacttggatacccatgtgcacaattaggtatgaatttccctcacagactgcaaagtgccagtttaaatagatctcacctgttaaagcaaatctatgttagactcacctcttcctggaatcataggctctaatagcacttagaatgtaagaaacagttttggatgagaatacagtttgctgtggataaattgaaaattgattacactatatgtggtttgaagtttaattttatttcattcatcatctgtaatgttttacttaaatacaaattataatgtcatgcccaaaggaaaataatcctatgatataaactgtcattgacttttataagtgaattcttacttgaatttttattttatactagggtactgagatcatatagtactttcatgggcttacagcaatttgaaacccatgagatttacagaaacttaaaacctcagtaaagcaattcagagattttctgaacaggtacggtggctcatgcctgtaatcccagcacttgggaggccgaggcaggcggatcatgaggtcaggagttcgagaccagcctggtgaaatcccgtctgtactaaaaatacaaaaaaattacctgggcatggtggtgcgcacctgtacaatcccagctactcgggaggctgaagcaggagaatcatttgaacccaggagccagaggttgcagtgagccaagatcacgccactgccctccagcctgggcgatagagtgagattctctcaaaaaaaaaaaaaactcaaagattttcaactgacttcatcatattagttaaaattaaatgttacctgtggatttcatattagatctataaatttgttatagcaaaaataagttgcttatttaaaaaagataaatattttcaagtaaaatgtatttcttttaaggtaccagttctatatgaccatattagaaattcagtttgggatttttttttttttcctttttggatggtgttccagcttgctatagaataaatgccaaaatgtctgtctagacactaagaatttcaaatcaaatgtattctaatttaaaaaagtctgtagtcaagattaattttagtacatttctcttcataaagcatttttcccttatatctacttattcagttgaattcagggatgtatttcttttttagaagataaatgagaaaatgagtatttaattatgttctctaaaactgagcacaagaaagaacacctagaattatttggaaataaaaccattctaaatctcttatatgtatttgggaataattttgctgctgtgtacaaagaaataaaatattttttagataagaaactaaggatcatgtattttgaaacattacacacctgtggtcagtgttaaggaaattgctcagaaataatgttaacagtttatttataaaattaatgtgatactataagcaatatttttaaaaatgtaatatcagagctctaaaggtatttttaatataattaaagtatgcataattactagtacaaaaaaagcctatatcttttgatttttaactttttgcttcaaaatgctgaatagaaaaactagtgagattagccaactctgggagaaatatgatactgcaatatgctgttcctcttatgaactgctgcttctacttaaaatctattgattatgcggaaagcatgaaaaatatagaaagatactaaaatgaaagtcgctcataatttgcattgctcagaaataatattaacagtttatttccctccaagattttgatgtgcatgtataatttattttaaaatggccagcatgtagttatgagacatcaggctgtttactcatctgtacagtggggataatagcaccttcctcatggtttgattaggaggatgaattgaaaaagttccataaggctgccacagtgtgatggtgatggtggtgatgatgatgttgtcattatgattatcgtaatatttagtatagtatcttttttaaaaaattaatatgagcaatataaaaagaataatgtattatcagagctctaaatgccctatgaaatcatgatttcaggtggttgcatcatattttatcttatttacaatataatttaaccacctcctttttcatcttcttcacattaaaggaggaaaagaaataccatgcttctttccatttccgaatgatctcttgtctcctcactgacctctagttaatttctataataagtgatttctatcattcattcttaactttctttaaaacttctaagaaatgtaatttcttaagtggtttgccctaagctctgaaattttttatatttggggtcagggagagtaatgacttcatatgcagatttttagctttttctttaagagcaaggattacccttaataccagttataaggataatgttttgagctataacacatatgtggtttgtgttttgaccttctttgaacaagctttctaaaatggtgtttcatcaatataattagcaaattaatatatctactccataggtatctttgagtgtctgtatctttcattaaaatcattctcattcaaaaattgttgcttcttcaaattcttttaattcactagatgataattaagtttttacatctattctcctacaattccactccccctactgcagtgttttttaattgtgaaagaagcatgaaaaagctatcttctaattatgtcttttgatttttaaaattattaggattttgaatgtaaaatacatataagtattctaaaaatgaaacttttcttgaccaaggaagaaatacattaaaagtagagaagtctgattaaggttcattacagcattaatttagaaagtatgggaaagacagggaaaaatgtcagttttaaataattaaaacactgaattattagtactgctaggtcttttgcaagcactttatcattaacatgtgacttatgttttattccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttggaaatatattctattttgtctcttaaatatgaaatgtaaacctaaagatactttaatgtgtatatttgtcacagcaattatgtccagattaatgtaatgaaataggagaatgtaattctgaagc

SEQ ID NO: 429172 - DNA, 3210 bp, Homo sapiens
cagtggcaatcagctgagatcttttggctccgggcagttggacttaaccagttcctcctcttctcttggaagctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429173 - DNA, 2374 bp, Homo sapiens
tatgtgtatctgatcgtatattttttttaaatggcacatgctattttacaactttttaaaatgaatttaacaactttctgaacaaaaatatataatgcatatctttttaatattgtgtgtatatatgtaaagatatgtattgcatacattttaacctttttgttgttcgtcattgtttaggaaaaaaagacaaggattctaagtgagctatactaaaaagaataactatgatagttttatttagcacatcagtgaatatattctctatagcacaagaaattacttgcttgctcattgatttctttttcttccctgctgtatttgcagaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429174 - DNA, 6529 bp, Homo sapiens
cttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgcctttactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429175 - DNA, 1740 bp, Homo sapiens
  misc_feature (23)..(23): n is a, c, g, or t
actagtccacggttggctactgnctttccatatgaccgaaagcagtagcctaacgtctgtgactactggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429176 - DNA, 1174 bp, Homo sapiens
cttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttggaaatatattctattttgtctcttaaatatgaaatgtaaacctaaagatactttaatgtgtatatttgtcacagcaattatgtccagattaatgtaatgaaataggagaatgtaattctgaagc

SEQ ID NO: 429177 - DNA, 236 bp, Homo sapiens
gagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattggtaagttttaaaattgggggactttgtcatgtctggatcatgtctttaatgtaacttattacaatagt

SEQ ID NO: 429178 - DNA, 385 bp, Homo sapiens
ttattccttattctgtgaacttgttaaacagtaaacttgagttacttgttttatctccaaaatggaagatctgctaattcatttttagggaccatactggcacttacagctgtatgatcatgatgttactttctgctttgtctttatttttttggattagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccaggtataaaatatatcattaaaaatatatattttattcttaataaagaacacttatatgccattgtga

SEQ ID NO: 429179 - DNA, 4386 bp, Homo sapiens
tcgttattcctgaccaaaaatttaataggaggtggaatcactcatattttgttaaagtaattgttacatgtagtttctggtgcatacatagttgttggatggaaaaataaatataacaagcattattttgaatgaggcttgctcttgtttctttgggccccaaagatttatttacttaaaatagtttttaatttttgtgtgtgtgtcttaaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattggtaagcttgaacaggaaaatgaatctacgaaggtaaacataaggcagagggtttccatctttgcttgaagaagcacagaataaatgccatgtgatttccttttcctcctctgtcaatttcaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429180 - DNA, 6565 bp, Homo sapiens
cttgccatcgtgagagattggtacatgatgtgtaaattcagttcagcatatgtttcttcattatgaaaccactagcaatcccagctaaccatggagttatgggccagcaggagaaacactcacttcctgcagatttcacaaaactgcatcttactgacagtctccacccacaggtgacccacgtttcttctagccattcaggatgtagtatcactagtgattctgggagcagcagtctttctgatatctaccaggccacagaaagcgaggctggtgatatggacctgagtgggttgccagaaacagcagtggattccgaagacgacgacgatgaagaagacattgagagagcatcagatcctctgatgagcagggacattgtgagagactgcctagagaaggacccaattgaccggacagatgatgacattgaacaactcttggaatttatgcaccagttgcctgcttttgccaatatgacaatgtcagtgaggcgagaactctgtgctgtgatggtgttcgcagtggtggaaagagcagggaccatagtgttaaatgatggtgaagagctggactcctggtcagtgattctcaatggatctgtggaagtgacttatccagatggaaaagcagaaatactgtgcatgggaaatagttttggtgtctctcctaccatggacaaagaatacatgaaaggagtgatgagaacaaaggtggatgactgccagtttgtctgcatagcccagcaagattactgccgtattctcaatcaagtagaaaagaacatgcaaaaagttgaagaggaaggagagattgttatggtgaaagaacaccgagaacttgatcgaactggaacaagaaagggacacattgtcatcaagggtacctcagaaaggttaacaatgcatttggtggaagagcattcagtagtagatccaacattcatagaagactttctgttgacctataggacttttctttctagcccaatggaagtgggcaaaaagttattggagtggtttaatgacccgagcctcagggataaggttacacgggtagtattattgtgggtaaataatcacttcaatgactttgaaggagatcctgcaatgactcgatttttagaagaatttgaaaacaatctggaaagagagaaaatgggtggacacctaaggctgttgaatatcgcgtgtgctgctaaagcaaaaagaagattgatgacgttaacaaaaccatcccgagaagctcctttgccttttatcttacttggaggctctgagaagggatttggaatctttgttgacagtgtagattcaggtagcaaagcaactgaagcaggcttgaaacggggggatcagatattagaagtaaatggccaaaactttgaaaacattcagctgtcaaaagctatggaaattcttagaaataacacacatttatctatcactgtgaaaaccaatttatttgtatttaaagaacttctaacaagattgtcagaagagaaaagaaatggtgccccccaccttcctaaaattggtgacattaaaaaggccagtcgctactccattccagatcttgctgtagatgtagaacaggtgataggacttgaaaaagtgaacaaaaaaagtaaagccaacactgtgggaggaaggaacaagctgaaaaagatactcgacaagactcggatcagtatcttgccacagaaaccatacaatgatattgggattggtcagtctcaagatgacagcatagtaggattaaggcagacaaagcacatcccaactgcattgcctgtcagtggaaccttatcatccagtaatcctgatttattgcagtcacatcatcgcattttagacttcagtgctactcctgacttgccagatcaagtgctaagggtttttaaggctgatcagcaaagccgctacatcatgatcagtaaggacactacagcaaaggaagtggtcattcaggctatcagggagtttgctgttactgccaccccggatcaatattcactatgtgaggtctctgtcacacctgagggagtaatcaaacaaagaagacttccagatcagctttccaaacttgcagacagaatacaactgagtggaaggtattatctgaaaaacaacatggaaacagaaactctttgttcagatgaagatgctcaggagttgttgagagagagtcaaatttccctccttcagctcagcactgtggaagttgcaacacagctctctatgcgaaattttgaactctttcgcaacattgaacctactgaatatatagatgatttatttaaactcagatcaaaaaccagctgtgccaacctgaagagatttgaagaagtcattaaccaggaaacattttgggtagcatctgaaattctcagagaaacaaaccagctgaagaggatgaagatcattaagcatttcatcaagatagcactgcactgtagggaatgcaagaattttaactcaatgtttgcaatcatcagtggcctaaacctggcaccagtggcaagactgcgaacgacctgggagaaacttcccaataaatacgaaaaactatttcaagatctccaagacctgtttgatccttccagaaacatggcaaaatatcgtaatgttctcaatagtcaaaatctacaacctcccataatccctctattcccagttatcaaaaaggatctcaccttccttcacgaaggaaatgactcaaaagtagacgggctggtcaattttgagaagctaaggatgattgcaaaagaaattcgtcacgttggccgaatggcttcagtgaacatggaccctgccctcatgttcaggactcggaagaagaaatggcggagtttggggtctctcagccagggtagtacaaatgcaacagtgctagatgttgctcagacaggtggtcataaaaagcgggtacgtcgtagttcctttctcaatgccaaaaagctttatgaagatgcccaaatggctcgaaaagtgaagcagtacctttccaatttggagctagaaatggacgaggagagtcttcagacattatctctgcagtgtgagccagcaaccaacacattgcctaagaatcctggtgacaaaaagcctgtcaaatccgagacctctccagtagctccaagggcagggtcacaacagaaagctcagtccctgccacagccccagcagcagccaccaccagcacataaaatcaaccagggactacaggttcccgccgtgtccctttatccttcacggaagaaagtgcccgtaaaggatctcccaccttttggcataaactctccacaagctttaaaaaaaattctttctttgtctgaagaaggaagtttggaacgtcacaagaaacaggctgaagatacaatatcaaatgcatcttcgcagctttcttctcctcctacttctccacagagttctccaaggaaaggctatactttggctcccagtggtactgtggataatttttcagattctggtcacagtgaaatttcttcacgatccagtattgttagcaattcgtcttttgactcagtgccagtctcactgcacgatgagaggcgccagaggcattctgtcagcatcgtggaaacaaacctagggatgggcaggatggagaggcggaccatgattgaacctgatcagtatagcttggggtcctatgcaccaatgtccgagggccgaggcttatatgctacagctacagtaatttcttctccaagcacagaggaactttcccaggatcagggggatcgcgcgtcacttgatgctgctgacagtggccgtgggagctggacgtcatgctcaagtggctcccatgataatatacagacgatccagcaccagagaagctgggagactcttccattcgggcatactcactttgattattcaggggatcctgcaggtttatgggcatcaagcagccatatggaccaaattatgttttctgatcatagcacaaagtataacaggcaaaatcaaagtagagagagccttgaacaagcccagtcccgagcaagctgggcgtcttccacaggttactggggagaagactcagaaggtgacacaggcacaataaagcggaggggtggaaaggatgtttccattgaagccgaaagcagtagcctaacgtctgtgactacggaagaaaccaagcctgtccccatgcctgcccacatagctgtggcatcaagtactacaaaggggctcattgcacgaaaggagggcaggtatcgagagcccccgcccacccctcccggctacattggaattcccattactgactttccagaagggcactcccatccagccaggaaaccgccggactacaacgtggcccttcagagatcgcggatggtcgcacgatcctccgacacagctgggccttcatccgtacagcagccacatgggcatcccaccagcagcaggcctgtgaacaaacctcagtggcataaaccgaacgagtctgacccgcgcctcgccccctatcagtcccaagggttttccaccgaggaggatgaagatgaacaagtttctgctgtttgaggcacagacttttctggaagcagagcgagccacctgaaaggagagcacaagaagacgtcctgagcattggagccttggaactcacattctgaggacggtggaccagtttgcctccttccctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgttttttgtttttttttaagagaaacatttataactggatagcattgcagtgaaagcagcttgggatgttggagctaatgccagctgtttatactgctctttcaagacagcctccctttattgaattggcattagggaataaacaagcctttaaacgtgataaaagatcaaaaacctggttagacatgccagcctttgcaaggcaggttagtcaccaaagactaacctccaagtggctttatggacgctgcatatagagaaggcctaagtgtagcaaccatctgctcacagctgctattaaccctataatgactgaaatgacccctccactctatttttgtgttgttttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctata

SEQ ID NO: 429181 - DNA, 3338 bp, Homo sapiens
  misc_feature (2617)..(2617): n is a, c, g, or t
  misc_feature (2726)..(2726): n is a, c, g, or t
attgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggcttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttgctttatagattaagaaactagcagaagatggttaaattacttgcctattgtctcagaacggttaattagtggcagagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgcattggtggccacttctgaattatagctacatttcattatgaccccttctgctcncttccattttgctactgatgtcattcttgttatcaggctgtgcccctaccaggagttcatattgggttgacagggttatctatatttttgttcttgatttttgagtttnatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggctcacgcctgtaatcccagcactttggggggctgaggcgggtggatcacgaggtcaggagattgagaccatcctggctaacacggtgaaaccccacctctactaaaaatacaaaaacttagctgggcgtggtggcgggcgcctgtagtcccagctactggggaggctgaggcaggagaatggcgtgaacccaggaggcggagcttgcagtgagcccagatcgcgccactgcactccagcctgggtgacagtgagactccgtctcaaaaaaaaaaaaaaaaaaaaaaa

SEQ ID NO: 429182 - DNA, 3086 bp, Homo sapiens
  misc_feature (2617)..(2617): n is a, c, g, or t
  misc_feature (2726)..(2726): n is a, c, g, or t
  misc_feature (3056)..(3056): n is a, c, g, or t
attgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggcttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccatttttatttaactaaagtcatggagattttgagtttaaaggatgcagtatagatagtggtttagtgtttaggctctaatgccagtctaaaaggcaagtcatttaaccttgggagcctcagtttcctcactgtaaaacagggataataatagtaactacctcagggttgttgtaaggattaaatgagatgatatttgtaagatacttagctcaagtgcctggcacacaatgagcacactctataaatgttctactactactattattaacacctagtctagggatgcacagcagaatcccctagggttaaaaaacaaaacaaaacaaacaaaaaaaactgacggaatagccccactccagatcagaattcccagtgggctggggtctcggccagtgtattctccagtaatctcgccaggtgtttgaaacacccagtgctatctgaaaactatcagtaccccaaccctttgctttatagattaagaaactagcagaagatggttaaattacttgcctattgtctcagaacggttaattagtggcagagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgcattggtggccacttctgaattatagctacatttcattatgaccccttctgctcncttccattttgctactgatgtcattcttgttatcaggctgtgcccctaccaggagttcatattgggttgacagggttatctatatttttgttcttgatttttgagtttnatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggccctncgtgtatcctctagagtcagctatgaaatg

SEQ ID NO: 429183 - DNA, 1682 bp, Homo sapiens
ccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagcggggcagacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctc

SEQ ID NO: 429184 - DNA, 1893 bp, Homo sapiens
  misc_feature (1691)..(1691): n is a, c, g, or t
ccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagcggggcagacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaanaaaactcgagggggccggtaccaatcggccaagtgagtgatacactcctggcgacgtcacgcctgatggcacctgggaccataatcctgagatcccttgaccgggataaaagtcaaaggctcacaggccactgaggactggcgagcgcatgtagcatacacgggaccatggtggcgccatgctggccattgcgggggtggtg

SEQ ID NO: 429185 - DNA, 779 bp, Homo sapiens
ccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagcggggcagacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccaccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctc

SEQ ID NO: 429186 - DNA, 484 bp, Homo sapiens
cggcacgagtccttttctgtgcgcggcgctgtttccataggcagagcgggtgtcagactgaggatttcgcttcccctccaagacgctgggggtcttggctgctgccttacttcccagaggctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagccccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctc

SEQ ID NO: 429187 - DNA, 1918 bp, Homo sapiens
ccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagcggggcagacctaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaaaaaaaaaaaaaaaaaaaaaaaaaaaaaaaaaaaaaaaaaaaaaaaaaaaaaaaaaaaaaaaaaaaaagaaaaaaaaacaaaacaaagaaggaaaaaaaaaaaaacaacgaaagagggggggcgaacacaaaagaagtctacccacaaggagagaacgcggcaaaaaaagagaacacaagcacaacacaatgagagcaaaaaaagaaaagcaaccacgaaaaaaaggcg

SEQ ID NO: 429188 - DNA, 1194 bp, Homo sapiens
tcaagcttctaacgatgtacggggacatgtcttactactttgaccgcgatgatgtggctttgaagaactttgccaaatactttcttcaccaatctcatgaaaggcttttattgaaaactaagcaaacaaagatataggagcctgtattataatgaaaaatgcctaagttaaagatgcaattaagttaaatattttaaaaccaaagattaaagaggcagtctagacaattagactgtgcctacaacagtctgtctctaggaatcaggttcattcaggacatcaaggaatgtctgaagaggtttttagagcatgcttcagtgttaggacaggagcaatggaagaatgagacaataaactaagtaattgggaaggagaaagcttttttggagaaaaagttgatagagaacaagtcaaatagatataaaaggaaaaatgaaattgaagaacagaccaacacataaaagggaaaagatgttgtacttagggtttaattcatattagcagttgtttttttaagtggctaaacgttttcaagtttatttggggacagaaatggcaacttggacccaaagaaatctaacaagaatagaaggaaaatctcagcaaactgtactgactcctagatggagcaagagcataggccactattggcgaaggactctatgtagctctaagctacatagagactccttgataaaaaccactgggaactgctcttcaaagactgggacagtgatacgaagtgtaccctgaaagtcaggacaatttgagaggaaatatcagatgaaagcaaaacattcaaggaattattggatgaatttccagttgttactataattatagataggcatacaagagcttcttgtgtcccaaaggaaatgtgcctgagaaatttttagaattaagacagaattaaggcaacaagatggaagataacagaagagagccaggcaggacagtgataaatggaatccaagctcagatcagctgttaatccaattagaaaatgcaagccagttaagattatctaactcagaaaggtgagggcggccaagattttttggacaatggttgcttttggcagaccaaaacctactgacttatctctcacaactgaagtccccattagataaatctagaaccaaatgttagataagcacatgtccggcccagaaaagagagaaagttaaaaaa

SEQ ID NO: 429189 - DNA, 2242 bp, Homo sapiens
ggggactagccttgcagtgttttagactgttttgaaattctgttctttagaagagattttttttttcttcttaatatcaaacaaagaactgctgctattcctttgggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccgccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatac

SEQ ID NO: 429190 - DNA, 610 bp, Homo sapiens
ctttaacatagaaaaacaaaagggtttccggaagccctcaacaaaggaagggtcaacaaggtttcaacaaccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgaccta

SEQ ID NO: 429191 - DNA, 963 bp, Homo sapiens
ggggactagccttgcagtgttttagactgttttgaaattctgttctttagaagagattttttttttcttcttaatatcaaacaaagaactgctgctattcctttgggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagggtccacattccacagagagacacaattttgtgggtatagcccggcctggattttagtcgtctgtagtcgtgacttg

SEQ ID NO: 429192 - DNA, 3785 bp, Homo sapiens
accacagttctcagcctccagcccagaagagttacattaggaactctagagaaaacatgctctcagggagatgataagcaactcatgctgaagaatttttttttcagagcttccaaatattctactttcatatccgtttgactcaacatctttaaagaaatggataatgatgaaagacttcaaaaagtgttaaggattaatttgaaagagaagttatataccctgaatagaaaaattgaagaaagaagaagctagatatttggagaaatttaaaaagcaaaatgaggctgggtgcagtggttcacgcctgttaatcccagcactttgggaggccaaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccgccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcctgtttggattttacactcaccttcgtgttttaaagaagcctcagagtgcactgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgaccta

SEQ ID NO: 429193 - DNA, 2620 bp, Homo sapiens
aacatctattactttctgaagacttctcaaccccatttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccgccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcctgtttggattttacactcaccttcgtgttttaaagaagcctcagagtgcactgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgaccta

SEQ ID NO: 429194 - DNA, 1196 bp, Homo sapiens
cggtgctctccagggcagcccctctcagacgaggaggcaccgggtgcagccaggtgtcttcagagcagccacaaaggtggcctaggatgcgggtgtctccccaggtgagtctgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgaccta

SEQ ID NO: 429195 - DNA, 4452 bp, Homo sapiens
ggggactagccttgcagtgttttagactgttttgaaattctgttctttagaagagattttttttttcttcttaatatcaaacaaagaactgctgctattcctttgggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccgccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcctgtttggattttacactcaccttcgtgttttaaagaagcctcagagtgcactgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgaccta

SEQ ID NO: 429196 - DNA, 4576 bp, Homo sapiens
ggggactagccttgcagtgttttagactgttttgaaattctgttctttagaagagattttttttttcttcttaatatcaaacaaagaactgctgctattcctttgggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccgccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcctgtttggattttacactcaccttcgtgttttaaagaagcctcagagtgcactgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagaacatctcattcatttcttagatttgtgttcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgacctaaaaaaaaaacacaaaggggggcgtttaaagtacctcagggccacttccttccgttttgcaagggccaacggggataataggcgccgtacatcgtggactggctcggctggagcccctgggcatg

SEQ ID NO: 429197 - DNA, 1379 bp, Homo sapiens
  misc_feature (1348)..(1348): n is a, c, g, or t
  misc_feature (1351)..(1351): n is a, c, g, or t
  misc_feature (1359)..(1359): n is a, c, g, or t
ggggactagccttgcagtgttttagactgttttgaaattctgttctttagaagagattttttttttcttcttaatatcaaacaaagaactgctgctattcctttgggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccagggcagaggaccaacgtngangcggccgngaatttagtagtagtcgacc

SEQ ID NO: 429198 - DNA, 293 bp, Homo sapiens
ttgcagaatcagccgtgtacgtagtacctcctcttggacgtctggcaggcatcttcagtgtcatgtgtcaaaagcagagagctcttggtttgtcctctcagcctcttcctgctccactggtagccccatctccctaagtggcagtgcagttcactcagcaactcaagcaaaaacctgactcttccttgtctcttctcttccctcctttcataaccatgagcaaatcctgttgattctgcctttaaaatatatcctggctgagctcagtggctcatgcctataatctcagcact

SEQ ID NO: 429199 - DNA, 2645 bp, Homo sapiens
ctaaatccaagcatactgcaggataagaggatgcaaggttgtgagtaccaggaggcagggatcattggaggcctttggttttggggtcaaggaggtgctttatcttagttctcccactaccatctaacttgccaaaattatttcttctcctggattagtttattatcaaattggcaggcttttatgaggattaaatgaggtcatagatttatgtaaaatgtttgacataaaataggctctcaaaaagatagctattgttttgaaaaaatagaaatcaagtggccaatgagcccagatttgatttttttaaattagatatttgacttactcacatttctaaattttgacattctgagaatccattttagtacctgacttgagagttctgacagtctaagaattttgaaaatactgatgttcttaaataatttatttttgctttagaggcttgataagacattcagatattcctagattcatataggtgtttttttaagtccataaaataaagcttcatggtttgaagtaattcacggaatttgaaaaatatgcataaacagtctatgctgcctgggaggaaaagtctttttaagttaaacttatttactatagttatgatttatatatttaagaaaatgttctttatagagatttgttcatatgtattgttgacttgttttaatgatataaattggtgtattgctcccccaccttttattttgagaaaatttaaaccgttttttagatacaaaaaatatgattgtcatgtagaatgatattattaacatcttaaaaatcacctgtgccgggcacggtggctcacgcctgtaatcccagcactttaggaggctgaggtgggaggatcacctgaggtcaggagttcaagactagcctggccaacatggtgaaaccccatctctaataaaaatacaaaaattagccgggcgtgatggcacgtgcctgtagtcacagctactcaggaggctgaggcaggagaaccacttgaacttgggaggtggaggttgcagtgagccgagatcacaccactgcactccagcctgggcaatagagtcggactcttgtctaaaaaaaaaaaagaaaagaaaagaaatgacctgctaataaagtaatagaatggaaaaaacaaaacaaaacgaaacaaaaaaaaaaacaaaaaaggaagcataaagtatctagacaaggtgttatctggatttctggtactgttgaacataattagatgtcacatgatcagttacaatcaaaatctctttttgggtgattgagttttgctttagaatgctaatatcatggcattttcatattctaggttatctgtataagcagtaagatgccaaatatgtcagatagacatgttttggataaatcatggctgcttgaaaaagaaatccaactccagtctcccaaaaagcaaacacacaacccaacccattaatttacatttggtttgtctgaagtgatttgaactgtaattctgtaagtggaaatagaggtttgtgcaaaagtaatcacagtttttaattggcattttaatggcaaaaactgcaattacgttcacaccaacctatacatacttaaattgttttcttttgatacaagtgattttataaaatacaccactggccctccatatttgttgattccacatcagtgaattcaacgaactttggactgaaagtatttgagaaaaaatattgcatctgtattgaaatgtacagacttttttccttgttatttcctaaacaatacagtataacaactatttacataatattcacattgtagagtattaggtattataaataatccagagatgagttaaagtgtatgggaggatgtgcatagtttatatgcaaacagccatttttatatcaagggcttgagcagcaagtgtggtcctggaaccaatctcccatggatattgagggagagaactgtatatgataccattataagctgagggatggagagatgacacttgtcatcttaatagtttaaacccttcctactatttttttagtgagaggtaagtaagcttgaatcattccaggccaatattcttttactctcaattccttctattaatataccaccttccatcccaccaatcccctcaaaattatacagtgatatccaaatgcctaatggttcaaggagaggagagaaacaacaaaatactctcgttgttgttcttggatccaaatcattatcttgctgcattttccctatcatagcacactcccaatttctttcatgagtcattggtaatgagagttctgagtacttgttaatcttgctgtacttgtcaatttaaggcagtatcgttttcaaaacaaagcttgattatcattgacctgaactgagagttttttatttagtgtttaataatttcatttaacgacttaagttcttaaaaatttaaagtttgattatactttggaggatcacagattgttccataaccttaagcctccaactatttccgactttcactagaggatcatatatgcttcatggaaatgagtttattaaagctgtctagagtcacatatggttttttctaaatgaattgcttgcttaggcttacttgctttttaggttacctgttgcactagattgaggca

SEQ ID NO: 429200 - DNA, 265 bp, Homo sapiens
ggaggcagtgacactgtgggaggcaactcaggaggattgctttagcgctgaggagttgaagaccagcctgggcaacaaaaaaacaaaaaaattacccgggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429201 - DNA, 2651 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429202 - DNA, 2873 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggcccaggaggttgggggagactaacctggcaaggagcccccaatgagccacctctcctcaccccccaaaaaacataagggggagcacaaaggccacagtctcccccatggttcagaaaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429203 - DNA, 2754 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429204 - DNA, 2360 bp, Homo sapiens
tgggcccctcccagaccccctgggctactgagtgatgccccaccctgctgggtctaggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429205 - DNA, 3018 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatgtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429206 - DNA, 3357 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaacctgagggcctcagctttgcttatgagggagggactgggaaccagcagctcagggccacttcctctggcagcccccacctgacccctctgccttctcccatttctccttcatcttccaggggtcagcagactgcccctttcccttccatggtcattgtagcctgaatgaatttagtcccctgaactgaggtcaggggactaaaaccaagtaaagatgcccaggggtgggcatgggggtgtggactggcccaggagggagaaagcacaatccttgccctcagaaagaggttaagaagggaacctgccctcccctccccattgtctccttgtgttgagctggaaagggggcagagatgctttatatgagcttttatatttcacagaatggtgactttgcatatgccctggtgcattgtgggagctgctattgtcacgactaagacatttcttttggggtatccatctagccccagcctcgaaaggatggaagcagggcctccttgcaggaggtcatgttgtccatttgtctgctttcatacaagctggtccaaagaaagagttctctttcgtttggaacatctgttgggttggaagtccttccccaaatctatctgagtccttcttgctgcagagaaagccttcctgtgacctcatcctt

SEQ ID NO: 429207 - DNA, 3307 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatgtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429208 - DNA, 2009 bp, Homo sapiens
ccaacgcaccgtgttgggccaacgcaccgtgttgggccaacgcaccgtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429209 - DNA, 2349 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429210 - DNA, 1318 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccgggtgtgtgtccatggtggcaggcaggcctggctgtgggaggggttg

SEQ ID NO: 429211 - DNA, 242 bp, Homo sapiens
gcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccacccccacctccggtctgctcctgagacctggctctggctgtaaggccctc

SEQ ID NO: 429212 - DNA, 473 bp, Homo sapiens
cacccactcaccctagaataaacttaacagtgtcccgtggggggcagtgagtatggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429213 - DNA, 2699 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429214 - DNA, 2616 bp, Homo sapiens
acagccatccttcccaccgccaggcccaggaggttgggggagactaacctggcaaggagcccccaatgagccacctctcctcaccccccaaaaaacataagggggagcacaaaggccacagtctcccccatggttcagaaaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429215 - DNA, 3097 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaaaaaaaacaacagcaactccaacgacactacaataacactatcaatatccaacaacacataagtccaacaaataaacacccatcacaactacaacaccgatacaaacaacacaacaaaaacaagaccgccccacctcactaaataaaccacacagaacagaccactacaaataataatcacattctctacagacagaaacaagagggcgccccataacagagcacacgcccaatactacgaaacgacgaccagacggcggagaagcagaaaccagaacgcacagcacgagacgagcagacaaccagcacagcacagagactccgaggacgcacgaccacacactcggtgagggctactcatctgtggcgacgacccaccacatataccatcgcgtgcgg

SEQ ID NO: 429216 - DNA, 2988 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429217 - DNA, 3050 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaaaaaaaaaaaaaaaaaaaaaaaaaaaaaaaaaaaaaaaaaaaaaaaaaaagaaaaaaacacaggggagcaaaaaagcgaaaaccaaacaaagaggggaacgggggccgccaaaaaaatagacccgcaggagcgagcaaacagaacaaccgcacgcaagatttatactagcagaaagacgatcagcacaaaaacgggccaagcaacacactccggccccaggaacccgctaaaaacaaaaagacaacaaagaagaaacacgtcacgtcagaatgaagggcacaaccacaacggcggagcgaacaaaatgcgcacacacacaacaaaaacacccgcgcaaaaacacccgagtcc

SEQ ID NO: 429218 - DNA, 2410 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatgacaggacaggctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429219 - DNA, 1425 bp, Homo sapiens
gaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagaggccctatagaacctgtggccatccctgagcaccctgccaccaggtgacctcggccatactcactgccccccttgggcacccactcaccctagaataaacttaacagtgtcccgtggtaa

SEQ ID NO: 429220 - DNA, 485 bp, Homo sapiens
tttaccacgggacactgttaagtttattctagggtgagtgggtgcccaagggggggcagtgagtatggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 429221 - DNA, 7355 bp, Homo sapiens
  misc_feature (1878)..(1878): n is a, c, g, or t
  misc_feature (1890)..(1890): n is a, c, g, or t
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctgagagcaggaagtcgcatagagtctcnccattttgcccnggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429222 - DNA, 7745 bp, Homo sapiens
  misc_feature (2268)..(2268): n is a, c, g, or t
  misc_feature (2280)..(2280): n is a, c, g, or t
taagagagtaaggctaaaagccaagcttaggagatcagtctttccagcccctgcaggctttttcagtcaataccttaaagtgtaatgtccctttgaaaatgttgccaggagaagcaggcataacttgttctgttactcagcctgtttgtttccagttacagcatcatgattatgcaaataatcttttcttgaaactatgaaatcacatggctaaatgtaattgtcaaggcagcagttttctagaatttaagaagtaactgtagagaaaatgctcaacaatgtctttgtagtcagttttccctcattcttattcctctcaattccaaaataatgactggcacaatacagctttcaaatatgtgaaagaagaagatatcctcttaaacccctggacagacagcactggtatgaccctatgtaggtcacatgataatacccaagtatagagaagcaaggaatgctatgaacccagttttaagcccttataaaactgttgtccagaaactaagacaaaagtctcctatttaaaactattttaatgtttcatcactattgtattataaaatgggattaagattcttacctgattttttttttattgagacagagtctcactctgtcacccaggtggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctgagagcaggaagtcgcatagagtctcnccattttgcccnggctgatcttgaactcctggcctctagctgtcctcctgcctcagtctcccaaagggctgggattacagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429223 - DNA, 7211 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429224 - DNA, 7268 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctgagagcaggaagtcgcatagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429225 - DNA, 6446 bp, Homo sapiens
tctagtgtgaatgaataagatgatgtacaattggctcttcctttctcaggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429226 - DNA, 6615 bp, Homo sapiens
cattttaacgatacttaaggagaaagatgtacctcagaattgtgtggttactaagatcttaggcttaagagagactacctggatcctcgtccaactacttcctagcttggtgcccttgggcaagttatttaacgtttctgagcctcagttttggtatctgtagaatgtggataatagaatctacattgtagaacatcataaggactgcatgagcttggcacagggcctacacgcagcgtgctcagtggccaggagcactgctttgacctttttttccttctgtcttatttgaatgtagggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429227 - DNA, 6440 bp, Homo sapiens
taagctagaatatccagaaatgaattctgttgttactattaccggttactagataccatttataatataacaaggtctaatttgctgcttcgacagtacaagaattatgttttgggacctgaggaaatggcagtccccaagattattttgtttaattatttgatattagacaagctgaagcctcataaaatgatactgtaatatatatatgtatctgtaagttgagtcatgcagcactctcttttaaatgttcttgcttctagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429228 - DNA, 5871 bp, Homo sapiens
  misc_feature (8)..(9): n is a, c, g, or t
  misc_feature (16)..(16): n is a, c, g, or t
cagaggannccggaantcctttcaccaagtctcttgccttgggtccatgcattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctgagagcaggaagtcgcatagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429229 - DNA, 6069 bp, Homo sapiens
acttggggttgattttttttttctttctttgttttattttttctttcccatggattttatgtcatccaccaaataggcacaggtcatcacagaacctctcttgttgcatgcagtgataatgagtggtccttgaccagcaggccagctgagcttagtccccttgcacaggccatgctctagtggccagcacattgagtctttgtcactgcaaggagaaatgaaggcatcctgtcttgctagagaacttggtagtatttgtacttctgtgagtgtggacctcgaatgcttgcagcatctgccagagaagaggacagaagtcagtaatttccctgtgtggctttattttgctattactactggtaaatattcctcaaagcctgagcataagaaataaaatctttggagattgaaatcaagggcttatgtctgtggatagggtgaggaagggttaagaacaacctgactaaagtgtcttgtgctcccggtgggtgtggctgttagcaatatcttggtcacctggagagagagaagaaattcaagtgtaactagcagagtagccatgtctctccgctgcacgtattaattcacactgtaagtgtcacatacttttctttgagtgattctgttttctgtttcctagttcatttgtgaaagcaaattgttaaagtggtgtcctaattttaatgttgatctgatttcctgtttctttcctcctcatgcagattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429230 - DNA, 5766 bp, Homo sapiens
agagctgaaatgtttaatgctggctctctggggggaaaaaattcctgatttgtagcatctgccaattcctgtgatgtcagtatactcccaccatagccaggttacagctgctgaccctggggcgggaatcgcctgtgcaagccaactccagctcatggggctcactggggctgtgctgctcccacattttttcctggtgattggaggagagaccgcccagcggacttgattccagatagatggatgtgcctctgagtggtcctcatctgcattagaggtggcctcttgactgagaaggtatctgaatgaggcttacttttaaaaatgagaagttaacgagctcttcattttgttctttcttctctctagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429231 - DNA, 5451 bp, Homo sapiens
  misc_feature (19)..(19): n is a, c, g, or t
  misc_feature (21)..(21): n is a, c, g, or t
  misc_feature (55)..(55): n is a, c, g, or t
  misc_feature (88)..(88): n is a, c, g, or t
  misc_feature (94)..(94): n is a, c, g, or t
gggaaaagtttcggcaatnangccttggcttaatttaaacctttaggccaaaagncttggaaaacttttttcaagaacaatttatttnaccgtncttggatttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429232 - DNA, 5197 bp, Homo sapiens
tgacgtttcatccaggcagctggtagagccacttccactggaagtggaacagcgagtgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429233 - DNA, 4080 bp, Homo sapiens
acccacgcgtccgacccacgcgtccgcggacgcgtgggtcgacccacgcgtccgattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429234 - DNA, 4316 bp, Homo sapiens
  misc_feature (31)..(31): n is a, c, g, or t
atacatttctttccatccatcaggcaacatnctcagtcagaaaaccacctcccaccacctgtgctgtgccacagggcatgatccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429235 - DNA, 2344 bp, Homo sapiens
gacaaataaaaatacggtctagtacgaggctctgtggttaatcggcagaggtggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429236 - DNA, 7273 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctagaaaattatttcttggacaataggaacagtcattgatctgtaaatcctggctcttaacagtgagtggccaaggacttgatcagcccatttcttggtccctcagtgctttaaaatttaagtagcactgcattttgtaatgttgaatatgactctagtgacttgtaggaggcacttgtgaggagatgcttgcttcagtgtaaaagatgctcatggcctgagtcagttgagttttctttcaagaaaccacttcagagtgaaatatccagggtttccccgccctggacatgtccagcctgcccaggcagcacacagccctgtaagtccacctcgtgtgggtgagatttcctcctgcgtgatgacctcatcgccatctctgctgtctcattccacagcctccctccctcttctctcctcctctgccctcgcccttcccccttccccatcccctccccctcctcctctgccctcgcccttacccctcccccttccccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaacaccgtcgaagtgttgtctaaatcatggaatagctatgaccattaatacgatgcactgccgtc

SEQ ID NO: 429237 - DNA, 5536 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429238 - DNA, 5057 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatgaattcaacagacttggtccccatagtccaagagtatgtatgtgaagaaagtgagcatgattcaacagtttcactctcagggattttaggatggcaaaatacttcacagaaactcaatgattaagttcccttccacacttccagagcttgaatgaacacaggtagccacctaaattgagcagtattgcaactcagagagaaaatcatctgaatagtaggacaagctcagaaggtacattgtgactgagggcttaaaaggagaccaaaacatggccccatcagggaagcttcttaatgcttggggggccagctaggtagggttgcttccaaaagctggagcccacccctgcctaggggttgtcagagagccacacctgcaggggaacaggtacctccgagggtgagagtcgtggtctctgggagttgttttctcacctctggcttagaagggtcaggcagaaaccacaggatgtggggtcacactcactgtcccaagtttgggaacctgaaaaagtctccattcagaacatggttgttctccctgtcccatgctatcttatcttcctaaatgactaatgaggaagcgggtgttctttttctgcactttgattcgccatctgggttctgtagggtgctctgaaggtgtgatctgccttctggctgatgtggaggaagagcaagcgccttcccaggccacagctgctcacctctcggcagatattttaggcaagcatccgtgtgtcttcccatcttcaggagaaaggtaaatgcaccctaagtgttcacttctggacctttttcaagttcacttgggactgtgtgacagaagggagttggagggaggatgggaatatttttaacactttgttttcctgtgcagaaacataataccagttttcgcagaaatgtgtctcaatctgtgactaccaaagccctcctcagtccttccctcagagggacacatttgctgtttctcccgcaagcagatgttgtggatgaggcgatagactccttggcaagaacgaaaggtgtgatgaaacctccctgctcggaagggtctccgtggaggtgtcctcatttcacatgctgggttttgcaagcgaggaagccaggcagtggaggaactagagagaggcaggcgtgtgtgtggacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagaaaagtcaaaaccccagcccaagattgggaaagcaggtggtggttccaagcttttaaaaaattattgaagctctccatcctgttctgtgagtgtgtcttctctttctccttcacgtcatagccgtgacccaccgttcatctctgctcttgcgtaaagatgaccgatggagtccaaagccaagtggcttcaccagctgacaagccaccctcctgcagcctgagtttcacagtccactgggttcgttgtcatgcggtgtttgaatggttaagcccttgcagtatttcagatcgggcaaaaaatatcggatgcacatagcagaaccattggtggtatttatagctttgctttgtactcctcactgtttctgcctacgcaaaatatccatgtttcctctgagaaatctgttgtggactgaaagcgctgctggctgtgaaatttaataaagtgtgtatgctttgctaga

SEQ ID NO: 429239 - DNA, 1725 bp, Homo sapiens
  misc_feature (40)..(40): n is a, c, g, or t
taatcggcctaagtgctacgagggccccgagcggtttttnaatatcggcagaggcttcccttccgctcctcctccctcctccacctctttctcctcctccttccctcctcctccctcctcttcccttctctgccatctttctccccgtgcctattgatcccacataggctcattctgggtacaccggctaaaggctttggtgcattgcagcgttttctcccagcagctgtgtgaaagatgcattttctaagctaaggagaattttctcaagagtggcatactcatgccaaatattattgctctgggccatataggctggtcttcctccacactaaaatgggtgtcttgttttggtacttaaaacagtctactccaggcatccagtccttacagaccaaggaagagcatagcgatgcctgttggaattgcagatgcattctggccttctcccccgtcctgaaacattttctttgaggaaggctcttagaacattagatagtctgctgaggttgttggcccagctccatacacccagtagaacagtggaacaactcatgcttcatgctgccaagctgctgtacttcaaaggaaacagatctagcacactgctgcacccctgcttccacactccacacttcaccccgctgcttttctctgacccgcccctggccttgtaagactcacgtaagctaagtccaggatgcctgtggcctgcggcttgattcttccctttaggattcagcaagttaatggcttcctcgctatagaagtgagactttgacttgatgcctcttggtatatcaaaaagatattcatccagaaagtaccaaatgttctgaaagacccgctcttcactccagttttccctagggtgtttctggcagggcgtttttaaaaggcatctacctgagttgacgctaatacttgtcaccacctggaacgtagttatcggtcggcaggctgaacatactccagattccccagaggccacttctgtagcccagcgatgcatctgagcctctctgcgtggtttatgcttgaaaaatagataatgcttttagatggttcactgccaggccatgggccccacacatctcaggccctgtgtgagggagcacactgagatggtgcaggagtgaatgggcatggcttggcctcgctacctcggggacctgttggagttctggcagcagggtgtctgcaggtgggacggcgttctgggcagagtcagaatggtcagaatgaaacagaacagccaactcacccacaggacagcttattttgaggcaaggttttggattttggaggaagcagccagatgaggcggtgagcctccagaaggtcagcctttggagcacgtaagatactgttacagggtccagaaatcgtgttcacatgggggctttgactcttcaaacagcttttgcagatcgtaaattgcatttgcctagtcgtgtgacctcaaaagaagtcagacatatttaatccagaaatagtttcgtttgagggagggcttgcaggtctgtaaatagcatttgctttcctggttagagattgggatgcagaaggagttttcagtattttttttaaaacactaatgatcattgaagagtatttatgtaaacatacaacgtataatgggtgggggatccgatcatggtgatgtacggggtgaattctcttgccgtgttgcaaatgtgtaaaataaagattatctggcagaac

SEQ ID NO: 429240 - DNA, 3185 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcctacagtgaactattggcaccaccgacagtgacaccagggcacatggctggagcacagtgccgcggaaacctgattttgtactctcttttatggaaacgatctgtggctgtttagaggcagctggatcctctttcaggcgggaatgggagggcgggcacagggaggaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggagggtgcgaggtgtctgtctgatgctttaggaaatgtctactgaggaccctgggacttaagaagaagggcggggagagtgccattgcctgtttgggagacaaaaatgaacgaaaacaggtgactttggaaagcaaagtcaaaacccagtttaggatgtagcacctgccccaggattcctgccctcggctttgccccagacccttattccagatgctgagagtgaccaggacagcagctcctgaggcccagtggtcttctttccaacaggaaaagaaggctgtgatgtcgctgtcaggatcatgccctgtggcacagcacaggtggtgggaggtggttttctgactgagatgttgcctgatggatggaaagaaatgtatttttaagttcaaaaagcattatcctgtggcgttgcctggacatccactccctgacagcccagagcagcactgtctggcttcccttcatgcttgtggctttgttgtgtttgatcagaattttgggggaaatggaaagttttcctcaaggagcagctgggggcagaataggtagtatttaagcaaatacttaagtccaagcaaatcatccccattaaaaagcttttcctgtaggctagtaggatttctaaatagatga

SEQ ID NO: 429241 - DNA, 2268 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacgtcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagagcagccaggggtagtttggagaaggaggtgttgagtcagttgtataaggaggaggttgggggtgactgctgcttattaagatgattcatttcatttccactcgtggttgtgattttcaccttctcaaaactgagtcagcaagagaaaatcttgtcttagaagggccagataacacttcgctgtgagaacaggagggataatggattggagatggctatgtgtaaagcagccctgcctgctgatttaacacactttcaaaatagatgtgtcagtattcatttaaagcaagactctgatgacagaaggaaccttgaaaactacctgatattgaaatggttgtgccctttatagcccttttgcatctccttgactttccagtcatgcctcctaaatcagaagaaaagctgcaaagaaaatgttttgtgtggttctgggcttatttgaataatgttcatgaccacaggctgccatagcacaagtgagaatttcagaccacaagggtttaaggagcagtgctctcttctctcaaagctcagaacggtctctggatccatggtatcgtacacccagtgtggatattaacattctttaatgcaggttatgaataataaataaaacaggtttttgttaataaagtt

SEQ ID NO: 429242 - DNA, 2604 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagaaggcaagttctctcgtgctcattttgtgttgctcagcttgctctgaacccacgtgctgcggcactgcggaggagtggaggcagcctatggtgtcaagatgctgtcttcctgggaggagagctaggggaggcctggggcccacttcgtgagagcagccaggggtagtttggagaaggaggtgttgagtcagttgtataaggaggaggttgggggtgactgctgcttattaagatgattcatttcatttccactcgtggttgtgattttcaccttctcaaaactgagtcagcaagagaaaatcttgtcttagaagggccagataacacttcgctgtgagaacaggagggataatggattggagatggctatgtgtaaagcagccctgcctgctgatttaacacactttcaaaatagatgtgtcagtattcatttaaagcaagactctgatgacagaaggaaccttgaaaactacctgatattgaaatggttgtgccctttatagcccttttgcatctccttgactttccagtcatgcctcctaaatcagaagaaaagctgcaaagaaaatgttttgtgtggttctgggcttatttgaataatgttcatgaccacaggctgccatagcacaagtgagaatttcagaccacaagggtttaaggagcagtgctctcttctctcaaagctcagaacggtctctggatccatggtatcgtacacccagtgtggatattaacattctttaatgcaggttatgaataataaataaaacaggtttttgttaataaagtt

SEQ ID NO: 429243 - DNA, 2493 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgttgtgacaacatctggggtgatggaaagtatgaagaaagtcaagaaggtgaccaacggctccgtggagccccagggcgagtgggaaggcgccgtgtgacagagccgaccctgaggatggcactgtccaaggaaactgttaacttattcatagtcctattggacagcaggagcagctcttggacactaggaaaaaccttgtgagagagtaaaaattttacacccatagtaagctaaaagcagcaccattagaaaggtcaggtcaacaccactacttaaaatccaaactttatggattctgcaccatgggcccattttccttttaaaacttttgtggtttaggtactgaaaattttctcgttagctgggtattaaatgatgcataggccatttattcaccagttttccctgtgacacaggtgttga

SEQ ID NO: 429244 - DNA, 2499 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaagctgctattaacttagcaaagctgaaacttttcagacattattacgtcttgattgtgtgttacatatacttcactaggatcattgcatttctcctcaaactcgctgttccattccagtggaagtggctctaccagctcctggatgaaacggccacactggtcttctttgttctaacggggtataaattccgtccggcttcagataacccctacctacaactttctcaggaagaagaagacttggaaatggagtccgtgtaagaaatctttcttccctcttccttagccctgacccctttgcctaacacaaagcagcacagtgtgaatcgggtcggctgctctcagcatttcgtggctgcaggggtggttcctctatttttagcagaaggaagcggacactggagccccaggctgtctgatctggtttgaagtacagtatctgccaaacctagctgggtcttgtcagggaagatggaacttgccgttccactaagcatcattggagcctgctttcaagaactcagtggcaagaacttaggaatatacgtggccagttcacgagggagaacagggggccgactttctgtcaggcccgccatcaggcgcttacgtctgaaaatggaatcttctgagtcatctctaagtctgctaatgatcctcagacatcctctatcgtcagataactg

SEQ ID NO: 429245 - DNA, 2293 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaagatcttcatgattgtcattccactccaggtcctggcaaatgtagcctacatcatcatagagtccaccgaggagggcacgactgaatatggcttgtggaaggactctctatttctggtcgacctgttgtgttgtggtgccatcctcttcccagtggtgtggtcaatcagacatttacaagaagcatcagcaacagatggaaaaggtgacagcatgggacctcttcagcagagagcgaatctgagagcaggaagtcgcatagctgctattaacttagcaaagctgaaacttttcagacattattacgtcttgattgtgtgttacatatacttcactaggatcattgcatttctcctcaaacctaaaaaaaaaaaaaaaaaaaaaaaaaaaaaaaaaaaaaaaaaaaaaaaaaccccgcgggcccttttttgggggggggggaaaaagggggaaaaaaggggccatgtcgctcttagtcgtcgtttccccggcccccgactttttcgttgtgaacaaaggggggaaatattggcggggtcctccccataaaagggaggaccgttatttatttccgcataaacacccgcggtgttatcccggctggtttttagagatctcgccgacaacaaaatcaagcacgataaacaccagacaaaaaagtattctctatagatacacaccgag

SEQ ID NO: 429246 - DNA, 1632 bp, Homo sapiens
tattattgcaaccatttcgcttgtatttgagtgtgaagcgcctagaaaaccacaggacccctacggcgagccgggaatttttagatattttcctccgagtcaacgctcagtgaaatcagttcaatcagtggcccgacaccgtgcggctgacacagcttatcccccgaccctgagatcaggggtccccggagcccaaggtcgcttccaaagctcagcgaggcggaggtgcggcccgggctggtctggttcggccaccgttgttatggcaaccgccaataggttggcttcatctctaactgaaagtctgcacaggagcggccgatcgaagggccccgaggtgggcagcacaggctcctcgacgacttcctaggtcgcaatctccaggaaaacgaccacagggtcagcggagctagccgccgagccccgctccccgggcccttccggcggctgcgccctttcaccccggacgtgggcgggagaggaagcggctggtgatgctggaacaaacatggccgctctggcgcccgtcggctcccccgcctcccgcggtcctaggctggccgcgggcctccggctgctcccaatgctgggtttgctgcagttgctggccgagcctggcctgggccgcgtccatcacctggcactcaaggatgatgtgaggcataaagttcatctgaacacctttggcttcttcaaggatgggtacatggtggtgaatgtcagtagcctctcactgaatgagcctgaagacaaggatgtgactattggatttagcctagaccgtacaaagaatgatggcttttcttcttacctggatgaagatgtgaattactgtattttaaagaaacagtctgtctctgtcacccttttaatcctagacatctccagaagtgaggtaagagtaaagtctccaccagaagctggtacccagttaccaaagatcatcttcagcagggatgagaaagtccttggtcagagccaggagcctaatgttaaccctgcttcagcaggcaaccagacccagaagacacaagatggtggaaagtctaaaagaagtacagtggattcaaaggccatgggagagaaatccttttctgttcataataatggtggggcagtgtcatttcagtttttctttaacatcagcactgatgaccaagaaggcctttacagtctttattttcataaatgccttggaaaagaattgccaagtgacaagtttacattcagccttgatattgagatcacagagaagaatcctgacagctacctctcagcaggagaaattcctctccccaaattatacatctcaatggcctttttcttctttctttctgggaccatctggattcatatccttcgaaaacgacggaatgatgtatttaaaatccactggctgatggcggcccttcctttcaccaagtctctttccttggtgttccatgcaattgactaccactacatctcctcccagggcttccctatcgaaggctgggctgttgtgtactacataactcaccttttgaaaggggcgctactcttcatcaccattgcactcattggcactggctgggctttcattaagcacatcctttctgataaagacaaaaaaatacaaatgttgcgcggagg

SEQ ID NO: 429247 - DNA, 628 bp, Homo sapiens
cttctatgccggtgtcatcctaaaacatactattatgtctttttaggccatgggagagaaatccttttctgttcataataatggtggggcagtgtcatttcaggtatgtatgctctttgtgtaaagcctcctagaatttctctctaccatgtaaaagggtaatttttttttagaggaattttgaatttaggaataacaacttaggtatgccctgtatcagtcacttaaatgcagtagctctccttataacaagcccacaaggtggatattgttacccatctacttatcaaatcagaagtctctgagagtgaataactttgtgactatctagtgtaggtgacacggtacagtttccaacccagtcctgcctggctgttcccatgacccctttgccccaatcccatgctacctcccattcaaagtgtgccagaagcatagtaccccattctgaaaggaccattgatgatgatttacggtgatgttgtaattttagagatgatttcacctagactcagaggctttgagtgacctgcttagctgtcagagttattaattgcccatgagtgtttaggggcagcataatagcatacgtatgggaacaagatactggactgggcctcagaaccca

SEQ ID NO: 429248 - DNA, 499 bp, Homo sapiens
accccagcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactggtaagttcttcatttcttaaacaaagtgactgtttgactttatttttgagatgatattcacacttctaagttagatgcttccctaccagtgctatgatgagatgtctatttatttgtacttttctttaatctctataatttatgatgtttccatgccttaaaaaaacagagcaacccatgttcctttgtaagaccatgggcaggataaagatccatgattacatgccaaatactactaaaataaaaacttttttgggtaatgaaactatttccaggcccctgttgatgggagtatccaaaacaacagagtgttatttcag

SEQ ID NO: 429249 - DNA, 303 bp, Homo sapiens
  misc_feature (98)..(98): n is a, c, g, or t
  misc_feature (114)..(114): n is a, c, g, or t
  misc_feature (193)..(193): n is a, c, g, or t
  misc_feature (208)..(208): n is a, c, g, or t
cagcggcgggaaccactcggtttgctgcgataccatggaaggaggcgggggaagcggcaacaaaaccacagggggattggccggctttttcggagccngggacaggtctactcngcacgcggatttggctggcgtcccgattcattccacttaaaacctgaaaacattggaccacacaaagtcttactgatgntccagaccaacttcnttgacatggagaacatgtttgacttgctgaaaaagggagacagaagtgaaggaccttcctggagcagggcccttccgctttcagaagggccgtat

SEQ ID NO: 429250 - DNA, 4335 bp, Homo sapiens
accccagcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctg

SEQ ID NO: 429251 - DNA, 4370 bp, Homo sapiens
tgtttttaaaagtgctagtcaccagactgcacccttgccagcgcttcgcagctctcgaagtaaattatcgcaggatggcggccctcacctaggagaaccaggaaggcaggcagcgctagaacgacgggattgaattttactattgccaaaacaatcacattcaaattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctg

SEQ ID NO: 429252 - DNA, 4400 bp, Homo sapiens
tgtttttaaaagtgctagtcaccagactgcacccttgccagcgcttcgcagctctcgaagtaaattatcgcaggatggcggccctcacctaggagaaccaggaaggcaggcagcgctagaacgacgggattgaattttactattgccaaaacaatcacattcaaattcattccacttaaaacctgaaaacattggaccacacaaagtcttactggccttgcctcattttattgttaagatttagatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctg

SEQ ID NO: 429253 - DNA, 4288 bp, Homo sapiens
caggcgagagatgctgctagtttgcccagatgggagcagaggagatgccaacgcatgattggattctggaggtattttgaagattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctg

SEQ ID NO: 429254 - DNA, 3422 bp, Homo sapiens
ccgcctactactactactaaatcgcggccgcgtcgacatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctg

SEQ ID NO: 429255 - DNA, 4412 bp, Homo sapiens
accccagcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccatttctcttcccc

SEQ ID NO: 429256 - DNA, 1971 bp, Homo sapiens
agctttggctataaccgtaacggcgcgtcgttgcgacagcgcgctatcgatcatctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctg

SEQ ID NO: 429257 - DNA, 4416 bp, Homo sapiens
  misc_feature (4338)..(4338): n is a, c, g, or t
  misc_feature (4341)..(4341): n is a, c, g, or t
accccagcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgaanaanaacaaaaaaaaaagggggggcggcataaaattcccctggggcccattaccgtccagtttttgtcccaggccatag

SEQ ID NO: 429258 - DNA, 4637 bp, Homo sapiens
accccagcgaggcggagccggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaagaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggatagtcacctctgaaatctccaccctgatgattggaatgaaacggagtgaacatgagcccagctgagagaggagcaggaatgtgtgaaaaacagctgctctccttgtcccagctttgtgattgagccctctgtcttgctctctctgccttccctgtgtctttcttctcttaccagagcatctgtttgcagaggtaacattaccttccccagccacaggtatgtggaatacggtgaggaaaaaaaaaattaaaaaaaaaatgcaagctgtcaggatgcttaagctcttttcagacatctgcagtttcatccctaccttgttcacataccatccaagaggcacataggctacccaagagagccttggattcagtggtacactccttgggcccaagggctttagcagctggatatggggttccttgattttcctctgggcccaaatatagccctcacactcttggaatttccaggtatgggggtagccccaaaaggaggaatctcctatggccaataaggtatcttgactttatcaaagtagaagagagggtcacttcggagtcaaatcatacactaggcctttgatgctttaattcttcttcagttcattaaaagtaactactaaggaaaggttaaaaacttcccctcaaaaaggaatcaaccccaggaagtaattatttacaacgattttcccaaattttgtacaatctgtcctggaaagcaaaccccttttaaaatctaatgtctgggctttgagtattagctcatttagggtggacaaatgcattactgttttcaaactgctcacatttattcagtatttctccaagttgctatctactcagccttatgaatgcccctcgcttttctaaggccatgtgaaaatcacggcactgcccttagccttgtgtcatctgctttttcgttctgcgatatgcccagttcccaaatcaattataggtacctgtttaggagagaggaagattttacctctcaaagggtgagatttgaaatttacactaaaaagacaactttacatttaatgcttcacttaatgagacattcttttttttataagtctatttttctactcagtttcagaacactaatctgattttcactctgatttttaacgtttctttaaatatttataatgtagcttctttcaaaatattttcatgaaaaattacttttattataccattatgtgcatgttattggtagcaggcatagtttattatttagtactgaaacatgctcttttacctaacagtaaacaagtatgttttgatatatatctgttaatatgcttatagtggtaagaaatggacttgaggtcccaggagatttcattttattcaccctggtcagatacaataaaggctatgagtataaatacataacttcctaaccaggtgtagggcatgttcatgaatatcaaatcttttgatgctggacccaagagaggaaaagttgtagctaaatgttgatttacttataactagacgtctatgtgagaaaatatatgtatacatatatatgatatgcagaagtcactttttttatcaggctttattctccttacaaagccacagtttaactgtctgcaacagttggtttatgttaatgatagacaaatacccagtgtttgttactttttccaactaccactgtaatgataatctttctcacgtatatacatgcaacttcttggcttcatttccatgaagctgtttcaatatattcagtatactttgtccttaatgctgcttctgttaacagtgatctctttctttttttcattcttatatcttcattagttcatcataaatctgtccagttgaggcctcaggaccacggcatgatttcatgactccgaagtattttacagaaacattttttaaataagggaaatattttatataccagatggttcacaagtgatggctcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgaaaaaaaaaaaaaaaatataaaataattaaaaaaaataaaataataataggataataaaaatatgtataaaagaacaaagataaagtaaaaataaaataatatagagacacagataaacatctaggaagtagattaaatgaaagaagcgtatatgaattcaagaaaataaagctgggaaatgtatttgctataaaatgagaagtctcactgatagaggttctttattgctcatttggtgctacaaaactggactctgaaatctgtcacaaatacaaattgtacatttggagatgtctcaaag

SEQ ID NO: 429259 - DNA, 2117 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagc

SEQ ID NO: 429260 - DNA, 1973 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagc

SEQ ID NO: 429261 - DNA, 524 bp, Homo sapiens
tggggtggggcgcagaacaatctatgtagtccaaagcaccgcgttcaactgcacgactctcttattaaccccgctacggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagc

SEQ ID NO: 429262 - DNA, 410 bp, Homo sapiens
gagacgggtagatcacctgaggtcaagaattcaagaccagcctggccaacatggtgaaaccccgtctctactaaaaatacaaaaattagctgggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429263 - DNA, 3176 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429264 - DNA, 3718 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaaaaaaaaaaaaaaaaaaaaaaaaaaaacaaaaaacaaaaaaaaaaaaaacaaaaaaaaaaaaacaaaaaaaacaaacaaaaaaagcgggggcgcgcgcccccacaaattatctccccgagggggccacccacacacagcgcggccccaccccgttttttgacacaaggggcgcgccccaaaaaagggagcacggataaaataaaacagagggcgagcaggcggggggcgagatagaacacacagacgcgcgcgtgagagagggacaacgcgcggcagagcagcgggcgatccatgggaagagagagacaacaccacgcggggggcgaggaagaaacacgtgggggcacaacaaccatacaagaaagcagagaaacgaaccccgccgagagacaaaacaaaaaaaaaccgaacgacgagcgacaaaggccgcgacaaaaacacacacacagcaaaaacgagagcgcgagaagaaaaaaaagtggacacaagcaaagaggacacaacacactaagaaacaacactcacacaccagaggggacaga

SEQ ID NO: 429265 - DNA, 3213 bp, Homo sapiens
gacctatcctcatctgtgcaaggaggagtggccaactctggagcccaggctgttgcttcctggtctggtggtgaatcctccatagtctggtgagtgtagtgcccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429266 - DNA, 3076 bp, Homo sapiens
aactttacgacaggcgggattgttttgtggctgtcagctttccccgtggtctgagtttgtggctgcatttttatctctggtggctctgctacggcggcgcagaaatgaggcagaagcggaaagggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429267 - DNA, 3042 bp, Homo sapiens
gacctatcctcatctgtgcaaggaggagtggccaactctggagcccaggctgttgcttcctggtctggtggtgaatcctccatagtctgggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429268 - DNA, 2560 bp, Homo sapiens
agaaaagctgaagtgctaggtaatgctaggtaccaggcccagaagacaatttcgtagacttgcacagctgcaacggaagcaaaaggaacctacagagacctgagagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429269 - DNA, 2638 bp, Homo sapiens
agcatccccatgtgcatagttaggaagtagcagagccaggatttgaactcaggcagcctggctccagagcctacactctttaccactatctcatactaggaggacagagagaaggcagttttttgagacagagtaatgtcttaaaacctgcaacaggttaattattttagatttgctctacaggtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429270 - DNA, 1742 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcacccaggaaattatttaaaattttttcaggggtaaaaataaaataggggggtcaaattttttc

SEQ ID NO: 429271 - DNA, 1724 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggagtggatgtcctggggcagaggcagaggggaggccaccacagaagctgttca

SEQ ID NO: 429272 - DNA, 1714 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttgcatgctgctgatcgaggagcagaaaatcgttgtgaaagtgttgaaggcacaagcacagagtcagaaagctaaataaaaaaatgaaacttttttgagtaataaaaatgaaaagacgctg

SEQ ID NO: 429273 - DNA, 1583 bp, Homo sapiens
tggggtggggcgcagaacaatctatgtagtccaaagcaccgcgttcaactgcacgactctcttattaaccccgctacggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429274 - DNA, 1579 bp, Homo sapiens
tgtagaataacataataagagagccgggggggaattataggcagacgtgactctctttataaccaccgcctcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaa

SEQ ID NO: 429275 - DNA, 796 bp, Homo sapiens
aactttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagaaagcagacttgaagtgcctcctgtgcctggaatcatccatcaattttagactgctgtcttgatttttctttccaatctattctttttttcttccattacatcaaatccttattatgttacataatcattcatgtatcattgttgaccataaatgccacctttttgtcctctaggcttaccaccaagtctgacataaaatacatgatcaataaatacttactgttttgca

SEQ ID NO: 429276 - DNA, 1670 bp, Homo sapiens
cccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaatta

SEQ ID NO: 429277 - DNA, 2494 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429278 - DNA, 600 bp, Homo sapiens
aacccaaacagctctgctttaatctggtttatctactagggctctgcataaaacttcatttgaaaagttcttgcctccttccctcccttcctcaactgaggagagggccaagtcaaccctggggcccacacgaagtcgtttctcggatttgctccagtctctttgtaaagccaggcaggagagtgggcccatcccacagatacacacatgtcaagcactcttggcccctccagagcctaaagctgcctccttccctgactgacctcccactctctcctcagcaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429279 - DNA, 747 bp, Homo sapiens
  misc_feature (19)..(20): n is a, c, g, or t
  misc_feature (22)..(22): n is a, c, g, or t
tacggctaggtacgaggcnngntgttataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgtcgcgatttctgaggcagtgtgcgccagaggggtggggctgtcactgtccgc

SEQ ID NO: 429280 - DNA, 276 bp, Homo sapiens
acataaaaagctggtccagggttgacacattatagaatccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429281 - DNA, 2848 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaacaaagctaacaaacaaaacaaaacaaaggaagaggggggcgagcgacaagcgcacataactaaacaacgcgcggagagggcacgaacaacgagccagccccacctgcgtttttatgtgagaggcggccgccagcccgagcacggggccacacatgacggcaccaggcggcgggggcacgccgatcacacaacggaggacgagaaacagccggcgatgagtgtgctacggaagacacaccccctgtggcggggagcagacgggagcagccaccaccccacagggcggccgcgg

SEQ ID NO: 429282 - DNA, 2333 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacgggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429283 - DNA, 2158 bp, Homo sapiens
  misc_feature (2133)..(2133): n is a, c, g, or t
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgaccatcttantctgggcccagcctgctggtccgca

SEQ ID NO: 429284 - DNA, 2794 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcaggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaacaaagctaacaaacaaaacaaaacaaaggaagaggggggcgagcgacaagcgcacataactaaacaacgcgcggagagggcacgaacaacgagccagccccacctgcgtttttatgtgagaggcggccgccagcccgagcacggggccacacatgacggcaccaggcggcgggggcacgccgatcacacaacggaggacgagaaacagccggcgatgagtgtgctacggaagacacaccccctgtggcggggagcagacgggagcagccaccaccccacagggcggccgcgg

SEQ ID NO: 429285 - DNA, 1840 bp, Homo sapiens
ggagaatggggccagaacaatatacagggcgaacaggaaagggcaaaccgtagggacaggcgagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429286 - DNA, 2352 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggattgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaatta

SEQ ID NO: 429287 - DNA, 1783 bp, Homo sapiens
  misc_feature (19)..(20): n is a, c, g, or t
  misc_feature (22)..(22): n is a, c, g, or t
tacggctaggtacgaggcnngntgttataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429288 - DNA, 1440 bp, Homo sapiens
ggagactagccctagccctagggcctaaggcagcccaggcaggagcctctgccactgtcctcagctctctgctaagaagcaccaggcaaacacctcccgtgttaaaggtttaggtttgcccaagagggccccacggcagcagtggacaaatctcccttttccttttcttctcagagccaactaaactgggctggggcaaagtgccctgaattctttgagcagttgggaggtataggtggggagtctggggggatggggagggacagagccaaactttctgaggtgaaatgttgggtggggggctcactgcttccttctccttagatcctctcttctctctcaggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429289 - DNA, 1138 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429290 - DNA, 1060 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtaagaaagtgccctggacttggtgtgctctcatctgccccagccatttcttccctcttgccagctacctgagagaagtcttgagaaggaatttgaaagaaaagtgacaaagcgtga

SEQ ID NO: 429291 - DNA, 573 bp, Homo sapiens
gggcaggaggtggtcaggataattaatctctggctcccttccagctttaataattattttccaatttctgtactcacaccctcccctgtaatcaggtaaatattccggattggattgttgaccttcgccatgagttgacccacaagaaaatgccccatataaatgactgccgcagaggtgagtcctcagaggttatacctatcacagttaagcccaggggcctgggcttggtggcgctgagggtagagggataggcaggagggtctccacctggagtcaaggctgggactagggtgaaagaagtgaggcctcgccttgggcacaacatttaaagtggggagaagtcaaaagttccataatcaagataaataacatattaatgtggaaaaattcatgataaacataatatcaaaactttaagtaaaacgggattagtattactgatttctccttttgtttcagcttccaacatggcttggcatattttgataccttgactacagaggtttttttgcctgcccttaagttgttttttgtttgtttgtttgttttgagacgagtctcaccctgttg

SEQ ID NO: 429292 - DNA, 2443 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429293 - DNA, 2389 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcaggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429294 - DNA, 2258 bp, Homo sapiens
  misc_feature (2252)..(2252): n is a, c, g, or t
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgaagggtgttctcagcaatcgacaatgtcagacgcagccccagtccccaagcttgcaggccttcatgctcgagactcctggaggatgccccatccgttgcggaaggcccgcccgtncctctc

SEQ ID NO: 429295 - DNA, 2338 bp, Homo sapiens
ggtccggcgtgaagtacatccagcattacgtagaggaagaggcgtcaaggattgacgaggactagactagcatcggatatgggcaagctaatgtggcccgcgtgtgtcgaggtgtacgtacggaggttccattgaacctccgcgatgggagtgaggcgactccaagcggtatgactggtcgccgggggcagctagctagcatcaaggtacaccgctttatgagacgaggatcaagaccgatcacctgtctctgggagtggacatctcgacctagtcaacgagagtgactgggaaggactgatcccatgccagatggcggtcatgggcatgactgtacgggacggatctgagctggactacggcgtgattcgtgtcacggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429296 - DNA, 2642 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggattgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaagtgtcaggcatggtgctgtgtttttttgtagaggttaacttcatttactttgacacagcagtcttgggaggtggaagtattatatattataccctatttgacagataagacattgaggctctaaggagtgatgggacttatctaatagctacacatttgttgatggtgggacagggatcttggcccaggtggtgtgagcccaaagtctaccttcatcccatcagcctgaatctgtgaccttctcagtcctgagctatgaccagacatactcgaggaagggggtgtattt

SEQ ID NO: 429297 - DNA, 1448 bp, Homo sapiens
agtaggagagggtcttctgccagcatcactttgctaaactagtgtcctcttgttccagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429298 - DNA, 1275 bp, Homo sapiens
gctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 429299 - DNA, 878 bp, Homo sapiens
ttggctgctggtgcggtggcggttcggagtgagggtagcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctggatcagccacatcaactcagttgtccaccacaggggaattttgaatgtcttttgtttttgttttgttttgaaaaataataaacaggcaactgt

SEQ ID NO: 429300 - DNA, 2774 bp, Homo sapiens
atgcagcagatccgcccgcccttcatccgcgggcctccgcaccatgcctccaaccccaacagccccctgtccaaccccatgcttcccggcatcgggcccccgcccggtggccccagaaacctgggccccacttccagccccatgcaccggcccatgctatcgccccacatccaccccccgagcacccccaccatgcccgggaaccccccaggcctgctgcccccgccgcctccgggcgccccactgccgagtcttcccttcccgccagtgagcatgatgccaaatggcccgatgccggtgccccagatgatgaatttcgggctgccgtcgcttgccccgctggtgccgcccccgaccctgctcgtgccgtaccccgtgatcgtgcccctaccggtgcccatccccatccccatccctatccctcacgtcagcgactccaagccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagagatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgttaattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctcatt

SEQ ID NO: 429301 - DNA, 2733 bp, Homo sapiens
atgcagcagatccgcccgcccttcatccgcgggcctccgcaccatgcctccaaccccaacagccccctgtccaaccccatgcttcccggcatcgggcccccgcccggtggccccagaaacctgggccccacttccagccccatgcaccggcccatgctatcgccccacatccaccccccgagcacccccaccatgcccgggaaccccccaggcctgctgcccccgccgcctccgggcgccccactgccgagtcttcccttcccgccagtgagcatgatgccaaatggcccgatgccggtgccccagatgatgaatttcgggctgccgtcgcttgccccgctggtgccgcccccgaccctgctcgtgccgtaccccgtgatcgtgcccctaccggtgcccatccccatccccatccctatccctcacgtcagcgactccaagccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagagatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgttaattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaaga

SEQ ID NO: 429302 - DNA, 2857 bp, Homo sapiens
gcggacactccctgtccccccgggactccaagcagggctcgtccaagtccgcggactcgccccccggctgctcgggccaggccctgagcctggcgcccacgcccgccgagcatggccggagcgaggtggtggacctgacgcggcgcgccggcagccccccgggccccccgggcgcgggcggccagctcggcttcccaggcgtgctgcagggcccgcaggacggcgtcatcgacctgaccgtgggccaccgagcccggctgcacaacgtgatccaccgcgcgctgcacgcgcacgtcaaggcggagcgcgagccgggcgccgcggagcgcaggacctgcggcggctgcagggacggccactgcagcccgcccgccgccggcgacccaggcccgggcgccccggcgggccccgaggcggccgcggcctgcaacgtcatcgtgaacggcacgcgcggcgccgccgccgagggcgctaagagcgcggagccgcctcccgagcagccgccgccgccgccgccgcccgcgccccccaagaagctgctgtcgcctgaggaaccggcggtgagcgagctagagtcggtcaaggagaataactgtgcttccaactgccacctggacggggaggcggccaaaaagctgatgggcgaggaggccctggcggggggcgacaagtcagacccgaaccttaataaccccgcggacgaggaccatgcctatgctctgcggatgctgcccaagaccggctgcgtgatccagcctgtgccaaaacccgcggagaaggctgccatggcaccgtgcatcatctcctcgcccatgctcagcgccgggcctgaggacctggagccgccgctcaaaaggaggtgcctccgaattagaaatcagaataagtaaaaggaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagagatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgttaattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctcatt

SEQ ID NO: 429303 - DNA, 2866 bp, Homo sapiens
gactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttgaacgttcactcacagggtacgctcatggagagagggcgcagagcaaaccatgtcacgccatccaatgacaccagctggtcagctcaccaccccctctggctaaaactcaagcaaataaagccgcttcctgtcattaagcatctcagaggaagcagccctccctcgatggcctctagcccagagaagcccgcgcatcttggacccaccaagcaggcccagccttcctgctgccaccatctctgcttctccccagaggaacttagagatttcacccctggcttttaaaaaaaacgaaataccgacaagccacaaggaccaatgtaggtattctccccgccccatcttcaaggctcagcgactgaggctggaagatgatatggattggaacacaaaaaatctttttttaatctttttaaaaactgctgtggttttgctgctacactaagaattgtgatttgcattgtacggttttggacctatattgttcacgttttgatggcggagaggggtggtcctggaggcccaatgcttcagagtcatctctgtcctgcccgggatgcacttttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgttaattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctcatt

SEQ ID NO: 429304 - DNA, 1574 bp, Homo sapiens
cacggccagggaggcagcagacttttgtcacagctggaagtacacattgggcttcttggtcactgtcaccagggtgactgtaacctgttttatggtggcagtgatgtatatggttcccttgccaaggtcactagctatcccctgggagcagtgattcctgcagttagtctgcattttaaatgaagagttagaatattttattggctaatatacttttcttgttatttttacaaaggccacctttatcctttttgatgccatattttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgttaattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctcatt

SEQ ID NO: 429305 - DNA, 1401 bp, Homo sapiens
ccgtcattgtcttgttcctgatcttagaggaaaagcattcaactttttaccgttgagtatgatttagctgtgagtttgtcatatttggtctttcagtgttacacttttatggcttttaattttcgatttgacagatgtaagaagcagcatgaatagtttatactgtggtttttcagagactgaatgccaagagaactcggtaaatgtttattcttctcagctttctctttaaattcccctaaatagcgccccatttgggaacagagcaagagtgttgaactgaagaccaaaatgccctcaaggtgtaaaataatccgagggggaatatttgctgggcgtcaggaaagactcagatgaaatttcaaccctgatggttttcggtgatccaggaagtcagtgagacaatctctctatatgcagagccctttcatgttaattagaatggtatggacaaaccaatgaaaacaagagggaaagtgagaaagatcacccatgattctgtttcactgtttgctttctcctgtcatggttaagagaaatgtgcaattcgatcctcaatcagtgggtggaggataacagggtagattcacttgtgtgcacttgtacagttgtagctgcgagtccagaagtcctctagagcatgtgtactggcactgagttggtgagacagttgtggagtatcccattctgatgagtacagaaaaaaaaagaaaaagaaaagaagagaaaaaattaagaaaaaaatcaaaaaaggaagaaaactaaaaaaaaaaaaaatcaaatcaccttgtgattcagtgtatctgtttactaactcaaataaagcaattgttccctctggaggggtccaggtgcccccgccccacaaggccgcggagcctcagcaggaggggtggcgagttgcgggtgggcagggccaggacggtgtggcgccagccttgaagcaccacggcccaaggatgcggtgtacatactgtatttctagattctcctttgtacagagtcacttcacaagtcaagctactgttttacaggtgctccttatttattagagctgtgagagcttgggggacacacctggcgagcaagctcgctttttaaaaatgaaatttgggggcaggggaaggggaggcgggagggaggggaagctcgcaagcccggggagagatttataaaagtaaacaaaagaaaaccttccagcaacaaattaaaaaataataacaaatcaaccccagcaccaaacccacccaggcaggaagaagccgcccctcctctggggccatatttttctgctgggtcacaacattctcctctccctgactggtgtcagattcatcaaacaaaaaataaatctcgaagaaaaaaaatgcacttacatgtgcttatttggcttttctcatt

SEQ ID NO: 429306 - DNA, 1266 bp, Homo sapiens
gactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggttatccttgtctgtgtcattcagcttttcccattctaccaaggaggatgagcagaagatgactctgcataatttatggataatttctcctgtttttctgcctgtattctcccatgttatattgccattcattgtatctagagtgtaaaatttaaacattttagacttagaatgttgatccacaagattaatcctgacatgcttctgagactgatgtgaaaaaaattacaaagttaaatttctacaaaatttatgattataagatgtaggctgtatgatttttagtcttttcatttgatcttccttgcaaacttggttctgagtacttactgatacacttagatgtccaagaaatcaacttcagtatgagagaacataaaaatactttgggaaatgaggttgtgttctactattttccataaggatcctagttcttttttttccccccccgaagaaacag

SEQ ID NO: 429307 - DNA, 1299 bp, Homo sapiens
gactctccgcactatccttacccgtgacagccactgacgtcctccgccgctagaagagaccccgcttctcggcgcctgccctccccctcgcggctcggtccggccccgccagcaccgctacctccgccagcctcgccaccatcagcaccacctccaccgccgccgccgccgccaccaccaccgccggcggcggcagcagccatttcatctccacagaaaccagacacaaaaacatggcagaaatggagaaagaagggagacctcccgaaaataaacggagcaggaagccggctcacccagtgaaaagggagatcaatgaggagatgaagaactttgcagaaaacaccatgaatgaactccttggctggtatggctatgataaggttgaattaaaagatggtgaggatattgaattcaggagctaccctacagatggggagagccggcagcacatttctgttctcaaagaaaattctttgccaaaaccaaaattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcagaagatgatgtgtcaaatgtacaaataatgtgtgcctggtgccagaaagtgggaatcaagcgctattccctgagtatgggaagtgaggtgaaaagcttctgcagcgagaagtgctttgcggcctgccgacgagcctacttcaagagaaataaggctagagatgaagatggacatgctgaaaattttccccagcagcactatgctaaggaaactccaaggcttgccttcaagaataactgcgaactacttgtatgtgactggtgtaagcacataagacacacaaaagaatacctggattttggggacggggaaagaaggcttcagttctgcagtgcaaaatgtctcaatcaatacaaaatggacattttctacaaagagacccaggccaatcttccagctgggctgtgcagcacattacaccctcccatggaaaataaagcagaaggcaccggggtgcagctgctcactccagactcttggaatatcccgctaacagatgctcggaggaaggccccctccccggtggctacagctggccaaagccagggccctggcccgtcggcgtccaccaccgtctctccatctgacactgccaactgctctgtcactaaaatccccacgccagtgcccaagtccatccccatca

SEQ ID NO: 429308 - DNA, 511 bp, Homo sapiens
aattacccgaggacagtgttatttcaccatacaatataagcacaggctattcagggcttgccactggaaatggactcagtgactcacctgcagggtcaaaggatcatggcagtgtgcccattattgtacctttaattccaccacctttcataaagccaccagcaggtaagtcactactggtgttttcagtgataacaattcatagaaagttgttttaaccatcttaggaataattattaaatgctcaagttaactttggtagaggctgttttagggaccttataggtaagaaatgttaatacaggcatcacttagagtattactgttacattaggaaaatttccctacctactactacttaggctataaactttcaactgacagtaaaccttttctaccactgactacaaaacaaagttattttccttctctgaaatcacctgtttaaatgagaaaaaaaagataaaatggtttttaaaaataaaatatagacaatgactgtttagcaaga

SEQ ID NO: 429309 - DNA, 1017 bp, Homo sapiens
gtgtgggtaggggagtcctggggtcaaacctggggggagtatctgggcggggccaggtggctgggctggcttgatctcaggcagagctgggcgcttagcatcagtgaggaagttgttaaaaaacgcgacttcctttttcacttcctcaattttctctgcatgcttgttgaagatatgttgcgcacaaactcaggacccttgaatttcttgccactgagaggacacagccacttatccttgcccagttcctgcgtgtggaggtgacgaacttctccacttcctgctctgggtctttgcgccccatcttctgggcctcttcctctgagagtgactcctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429310 - DNA, 823 bp, Homo sapiens
aattccggaattccccggcctggccagggcggagcggcgcccagtagggacccattcattgtgccggcgcctcactgggcacggggcccaagctgacggcgtgcacgggagcctgcggagcctgggtgggaagaacaggcccctggagggcacttgaccttaagcctcttttcctccgagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429311 - DNA, 754 bp, Homo sapiens
tacccgcccggggcaatcagcagagacattgatactactgccattttccatgagagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429312 - DNA, 2644 bp, Homo sapiens
tcttcatccgggtgctgcggcgcgaataagagccggaccgcgcttgcgcattgagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacagaaactagcagctagtttcttacttgaacaagactattaaaaaccaaatatcaaaaaactgaattggctagatttttacagccaaaaattgctgtaaggcagtgtgtatcactgttgctaacatgtttatagtgggagtcttggggatgatagctggttcaacagtattttgctgctaatactttatgttgcttcttggtcaaacttttcccattcaaaggaagaagatggtgctactatagacagtttttcccctagcaaatatattgtaccataatatctatcatccaagtttcagggttttttgaaagttgataattaggaaagtgacattttacttttcttagtgccctttgcctgtttgatttccattgagaaagagcagtcaccaaagttcctcaagtgtcggaagaccaccaccatcagaatcagtgcttgtttaaaaaataaaaatccctaggttccagacctactgaattggactctttggacatgagactcagcaatctacatctttaaaaaggcttcccaggtggtttttgtgcatactgtttgagagtcactaagttatatatatatcctaccttctgtaaagtgaaatgaggccccaaaaagctaaagaggtagagctgctacctcgtttttagttgattcatcatctagtctatatcacccaaaagaattggaaataggtattcaaacaaaaacctgtatacaagtattcatagaagcactacttacaatagccgaaaggtagaaacaaccaaatgtctatcagctgatgaatggataagtaaaatacatccatataatggaatattcagccatgaaaaggaatgaggcactgatacataatgaatagatgtgagtgaaccctaagaaagcatgctaagtggaagaagccagccacatgattccatttatatgaaatatccaaaataggcaaatccatggtgacaaagccaattagtagttatcaggaactagggagggggtgaaaagggagtgactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagattattaaaatttgatgaattagtggtgatggttgcacaacattgtaaatataataaatgtcactgaattgtacactttaaggtggttaaaatggcaaattttacatgtcttactgaaactactgtactatttaatacaaagtacatagtataaaattttaaaagtgataggaaaatgcttagattaatattcacctattccaagtatattttaaataaaaacagtcttggtaaagaaaaaatc

SEQ ID NO: 429313 - DNA, 779 bp, Homo sapiens
aattccggaattccccggcctggccagggcggagcggcgcccagtagggacccattcattgtgccggcgcctcactgggcacggggcccaagctgacggcgtgcacgggagcctgcggagcctgggtgggaagaacaggcccctggagggcacttgaccttaagcctcttttcctccgagaggaagcgggagaggagcccacgtcgcctgtcacccaatatctccagccgcgcagtcccgaagagtatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429314 - DNA, 3299 bp, Homo sapiens
tcttcatccgggtgctgcggcgcgaataagagccggaccgcgcttgcgcattgagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttgggatgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacagaaactagcagctagtttcttacttgaacaagactattaaaaaccaaatatcaaaaaactgaattggctagatttttacagccaaaaattgctgtaaggcagtgtgtatcactgttgctaacatgtttatagtgggagtcttggggatgatagctggttcaacagtattttgctgctaatactttatgttgcttcttggtcaaacttttcccattcaaaggaagaagatggtgctactatagacagtttttcccctagcaaatatattgtaccataatatctatcatccaagtttcagggttttttgaaagttgataattaggaaagtgacattttacttttcttagtgccctttgcctgtttgatttccattgagaaagagcagtcaccaaagttcctcaagtgtcggaagaccaccaccatcagaatcagtgcttgtttaaaaaataaaaatccctaggttccagacctactgaattggactctttggacatgagactcagcaatctacatctttaaaaaggcttcccaggtggtttttgtgcatactgtttgagagtcactaagttatatatatatcctaccttctgtaaagtgaaatgaggccccaaaaagctaaagaggtagagctgctacctcgtttttagttgattcatcatctagtctatatcacccaaaagaattggaaataggtattcaaacaaaaacctgtatacaagtattcatagaagcactacttacaatagccgaaaggtagaaacaaccaaatgtctatcagctgatgaatggataagtaaaatacatccatataatggaatattcagccatgaaaaggaatgaggcactgatacataatgaatagatgtgagtgaaccctaagaaagcatgctaagtggaagaagccagccacatgattccatttatatgaaatatccaaaataggcaaatccatggtgacaaagccaattagtagttatcaggaactagggagggggtgaaaagggagtgactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagattattaaaatttgatgaattagtggtgatggttgcacaacattgtaaatataataaatgtcactgaattgtacactttaaggtggttaaaatggcaaattttacatgtcttactgaaactactgtactatttaatacaaagtacatagtataaaattttaaaagtgataggaaaatgcttagattaatattcacctattccaagtatattttaaataaaaacagtcttggtaaagaaaaaatc

SEQ ID NO: 429315 - DNA, 634 bp, Homo sapiens
tacccgcccggggcaatcagcagagacattgatactactgccattttccatgagagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaataaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429316 - DNA, 780 bp, Homo sapiens
gagaaatttctctatccaaaacttggccaagtatttatattcaagtctattgatttaagttgcctatatttaaaattataatagctacagttattgaaaaatgtactctattggactggatgcggtggctcacacctgtgttcctagcactgtgggaggccaaggagggaggattgcttgaccccaggagttcaagatcagcctgggccacatagtaagatcctgtttctacaaaacatttaaaaattagcccagcctggtggtcacctgtagtgttagctactcaggaggctgaggtggggagctggcttgagcccaggagttcaaggctatagtgagctatgatcacaccacactgtactgcactccagcctgggtgacagaccaggtgagaccttgtctcttttaagaaaaaacaaaacaaaaaaccctactttatttaaaagcatatttatatatgttgtttcttaattttcaacacccttttaagatgtagatattgttatccctgttacacaagagtgagattattctaagctcttgatttgtctctttacactcagctacaaaataaaaaagtagttatcattttgacaatatggtatttaattaaaatagctacctgtggttactgatacgacctttacctttattttctgttttccagggctctacggtatttaatggggcccagaatggtgtgtctcagctaatccaaagggagtttcagaccagtgcaatcagcagagacattgatactgctgccaaatttattggtgc

SEQ ID NO: 429317 - DNA, 753 bp, Homo sapiens
tcttcatccgggtgctgcggcgcgaataagagccggaccgcgcttgcgcattgagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429318 - DNA, 1099 bp, Homo sapiens
gtgtgggtaggggagtcctggggtcaaacctggggggagtatctgggcggggccaggtggctgggctggcttgatctcaggcagagctgggcgcttagcatcagtgaggaagttgttaaaaaacgcgacttcctttttcacttcctcaattttctctgcatgcttgttgaagatatgttgcgcacaaactcaggacccttgaatttcttgccactgagaggacacagccacttatccttgcccagttcctgcgtgtggaggtgacgaacttctccacttcctgctctgggtctttgcgccccatcttctgggcctcttcctctgagagtgactcctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaaaaacaccaatacagcacatacacagcgccccacatcccccaggcccacctgacaccaaaaaggggggggcccccaatcccc

SEQ ID NO: 429319 - DNA, 1931 bp, Homo sapiens
gtgtgggtaggggagtcctggggtcaaacctggggggagtatctgggcggggccaggtggctgggctggcttgatctcaggcagagctgggcgcttagcatcagtgaggaagttgttaaaaaacgcgacttcctttttcacttcctcaattttctctgcatgcttgttgaagatatgttgcgcacaaactcaggacccttgaatttcttgccactgagaggacacagccacttatccttgcccagttcctgcgtgtggaggtgacgaacttctccacttcctgctctgggtctttgcgccccatcttctgggcctcttcctctgagagtgactcctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaaaaaaaaaaaaaaaaaaaaaaaaaaaaaaaaaaaaaaaaaaaaaaaaaaaaaaaaaaaaaaaaaaaaaaaaaaaaaacaaacaaaaaaaagaaaaacaaaaaaaaaacgaaaaaacaacgaacaacaacccccgacgaccacacgaacacacacgaagaagcaaacaacgagacgaacgacaacgcagcggatacaccgaaggaagaacaaggaaggcggacggtgcccacccagagccgggagcgggccagcgccggcaccagccgcccccgcccgcgcgacgcccggccagcgacgtccgcccgcacacatacggacgacgcgccgacgccccccatgacctcgaaccagctagcgtcgacagcgcgacggctgccgcgccagaggcactgcatcgaagaggccgaccaacaccgacgccaccgcaagacacggcaggcgcagctaccgagccgcagcaaacaaccacaacaaaaagaaccgtactgcgaccagtcggccgacggcgcgagaccaacccgacgcgaaatcgacggaacgtcatcccaacccagcgagaccacgtcgaggctcgacagatcaagcacaggccacgggacatgcacaccgcacacacaagcagcaggacggaagagagagaccacgccgaaagcccacggcgagcacgagcaaaccgcaaacaacgcaagacgcgccaacgagcagacggcggatcagaacgcacccgccgacacaaagcgccgcagacagaacgaagaaagcaccagaacgcagaaaacggcaggcgcagcccgaccccgcagactccagcgcccagaacggcgcacgacgagcagccccacgcgaccaaggcaccagagctcgcacgccgcagatggacgcgagccgaggagaagacaacgacgtgcacgcg

SEQ ID NO: 429320 - DNA, 1408 bp, Homo sapiens
tcttcatccgggtgctgcggcgcgaataagagccggaccgcgcttgcgcattgagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttgggatgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 429321 - DNA, 705 bp, Homo sapiens
cggagcggagctgtgaggcgccagtgcggagcgggcgggcgggcgggcggcgcgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctc

SEQ ID NO: 429322 - DNA, 413 bp, Homo sapiens
accaaacgtgtcggtgctggagttgcagggagagactcccattctgatttctccttctccagctaccctaattacctttcttctctacctttgttcttttttaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctc

SEQ ID NO: 429323 - DNA, 957 bp, Homo sapiens
ttggggtagaagggagggagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429324 - DNA, 1014 bp, Homo sapiens
gtgtccatcccccttcgcgtgtccatcccccttcgtgtgtccatcccccttcgtgtgtccatcccccttcgtgtgtccatcccccttcgtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429325 - DNA, 2138 bp, Homo sapiens
  misc_feature (1271)..(1271): n is a, c, g, or t
cggagcggagctgtgaggcgccagtgcggagcgggcgggcgggcgggcggcgcgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtgggtggtcattgcgtttgagctgtgattttcatgagtcgcttcaaaatctcgtgtagggttgacaatgtgggggggtgggggatccagcttattcttttattttcaagtccattctnggggctggtggggaggcaggagaatacccctccctaagcccttagtgtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429326 - DNA, 2130 bp, Homo sapiens
  misc_feature (1263)..(1263): n is a, c, g, or t
gaaaatctcattttacttatgataaaaactgatgagttattatgtcctattggccctgtatttcccagggtgggaacaatgtctctgccaaagcttaggggctccctctcctaatgcttcacatccgtgttttctgttgccctcaccttctatactcccctcttgcactgagaccccacacccagcagctaatgttcactgcccagagcaaggagttgtcagccttacctctctgctccttctgtagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtgggtggtcattgcgtttgagctgtgattttcatgagtcgcttcaaaatctcgtgtagggttgacaatgtgggggggtgggggatccagcttattcttttattttcaagtccattctnggggctggtggggaggcaggagaatacccctccctaagcccttagtgtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429327 - DNA, 1628 bp, Homo sapiens
cggagcggagctgtgaggcgccagtgcggagcgggcgggcgggcgggcggcgcgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429328 - DNA, 1846 bp, Homo sapiens
  misc_feature (979)..(979): n is a, c, g, or t
accaaacgtgtcggtgctggagttgcagggagagactcccattctgatttctccttctccagctaccctaattacctttcttctctacctttgttcttttttaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtgggtggtcattgcgtttgagctgtgattttcatgagtcgcttcaaaatctcgtgtagggttgacaatgtgggggggtgggggatccagcttattcttttattttcaagtccattctnggggctggtggggaggcaggagaatacccctccctaagcccttagtgtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429329 - DNA, 1382 bp, Homo sapiens
  misc_feature (25)..(25): n is a, c, g, or t
  misc_feature (515)..(515): n is a, c, g, or t
aactaggctagtacgaggctgggtntgtgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtgggtggtcattgcgtttgagctgtgattttcatgagtcgcttcaaaatctcgtgtagggttgacaatgtgggggggtgggggatccagcttattcttttattttcaagtccattctnggggctggtggggaggcaggagaatacccctccctaagcccttagtgtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429330 - DNA, 1411 bp, Homo sapiens
  misc_feature (32)..(32): n is a, c, g, or t
  misc_feature (544)..(544): n is a, c, g, or t
gctcgctctagaggatccactccccgtacgcncaaaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtgggtggtcattgcgtttgagctgtgattttcatgagtcgcttcaaaatctcgtgtagggttgacaatgtgggggggtgggggatccagcttattcttttattttcaagtccattctnggggctggtggggaggcaggagaatacccctccctaagcccttagtgtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429331 - DNA, 839 bp, Homo sapiens
tcttctgctatggtcgacttctgctctggtcgaccttctgctctgggtcgaccttctagctctgggtcgaggttctgctctgggtcgaccttctgctctgggtcgaccttctagctctgggtcgaccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429332 - DNA, 1205 bp, Homo sapiens
ttggggtagaagggagggagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaaaactctcgtgtagggttgacaatgtgggggggtgggggatccagcttattcttttattttcaagtccattcttggggctggtggggaggcaggagaatacccctccctaagcccttagtgtgtgccgagcttgctttgtgatgttggcaggggaggggagacctgggtggtgactgagttccctttatcaaacccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgcaaaaaaaaaaaaaaaaaaaaaaaaaaaaaaaaaaaatccgggggattattattgggggggcggggaaaaaagagagcgaagcgggaaacgagggcccgtgggcacaacgagagttcccggcgaaccccagatttttggtgtcacccagggggaaaaaatcggcgcggaaccccatataaagggggaggcggaatataaactgggaaaagacccggggtaacacgggcttacagaaacccgcggcacaac

SEQ ID NO: 429333 - DNA, 1938 bp, Homo sapiens
  misc_feature (1271)..(1271): n is a, c, g, or t
cggagcggagctgtgaggcgccagtgcggagcgggcgggcgggcgggcggcgcgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtgggtggtcattgcgtttgagctgtgattttcatgagtcgcttcaaaatctcgtgtagggttgacaatgtgggggggtgggggatccagcttattcttttattttcaagtccattctnggggctggtggggaggcaggagaatacccctccctaagcccttagtgtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtctctggtgggaggtgaggatagaagtgataaagagctaagaggagcttctgggagccttggaggaggtcagtcttgcagtggtgaagccaggacataggagatggagcagggctgtgagaggaggagattctgaggaggatgcaggggaaatcttgtctgttaatgaaataggagtggggtggggtttggggtggggtggtcattgccgtttgagctgctgattttcatgagtcgccttcaatgggcacaaaattgagtgcttgattttaggttttatttttttatgaatgtccaaatctgtgtttccccctgccctcccagactgtgtggccagttgaaagtgtctggtttgtgttcatctctccctcatttctggagcagggcctgagaccctgccacatctcctatgctctgcatccacgcctcttttggacattaaaggttgattgatgca

SEQ ID NO: 429334 - DNA, 1509 bp, Homo sapiens
cggagcggagctgtgaggcgccagtgcggagcgggcgggcgggcgggcggcgcgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtttggggtggggagcagatttgtcttgctgtctttgtcagaatttctaagtaagggctgtgtctttgtggattaccttcttttgttcttcctgccagagatcatgacaggaggatgctggggtaggattagcttgaatcttttttttctttacatttttctcctgtctgctccctgcttagccctcagtttcctcattcctctggagttctcttagagcagcccctgttgttagttggctggcaagggaatttctggtgactgtagttccttagttaggtcttagcaatcaaaccaaattgatgtctcccttgactcttctgtgtatatgtgtgaatatgtgtgtatatgtgtgtgtatgtgt

SEQ ID NO: 429335 - DNA, 4441 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429336 - DNA, 4311 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429337 - DNA, 4500 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagagtggaggtgcaacaaatgagaaattccaattggagattttgtcaaacaggaatttactccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429338 - DNA, 4357 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccatgtggttcagcctcccccggagtggctgggggcatgcctggagataatccgtggaccgactaggggatcacagttttt

SEQ ID NO: 429339 - DNA, 3080 bp, Homo sapiens
aggctaactagaggatcccgtcactttctacacttctatgtaatcagaactataatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429340 - DNA, 1994 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagagtggaggtgcaacaaatgagaaattccaattggagattttgtcaaacaggaatttactccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429341 - DNA, 2274 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagtgcgtaacctttttcttctttagtgcttatttatttaattctctttttgttaggaattttaaaatattttaatctatgtgcacattttgcattttttaacatagacctttttaagcagtagcccaggtaagcttctccttgtattaatggtttttcttctacttgaaccaaattaatcttgcaagtaaacttagaaatttggaattagcaaaattgattgcatttaaaaattattcttgtgaaattccatgcaactataatttatcttaccagtttaaccctaatgtatcacagaaataataggaaaatagcaggtggcagtcacttgtagtaggatttatttagtttctgttttgagaagatgtagtcttttaggtataccattaagtctttaaattactcccttaattccacccgccaattctaatgcttacatgttccagccccactcccggctcacactcttaggcagaaattcattgctcctgtaaattaagtaataattaataccgctaatgagaaatctgggagtacaggaggtgattttaaaaaatgctcgtatttcctttgattagagtagcaattgttagggatacatgagccagatttggttttatgtaaaaaaaatctttcagttgatgagttcttgtttaaattgtattgctgtggcaatttcttattgtaataatatgtaggagaatttctaatttgaatccctttatttacagaaagctcactgtaaatttgtaggaatgtcatggtactaccccattaagttatttttattagtgtttagttattgattcagcagtctctaattgtgccaaaaatggtgcttagattagattgccattgctacccatgggagctgctacttaattattcccacctcaaattcccagctctcaagttagcactactcctttgcaatttactccttctctgctcgtataaataccctcagatgatgatagttggtggccactatacctttgaagaggttgcccacttctacatggaaaggaaaagatggtttttttttttaaaagatgaatttgataattaacttgccactatttcaccttgtgatgaaacctcaattttaaacatagtgttaattgttttattgtccacagaattaagggtaagtaatgtcatacaatttttgtctttagtcttttagtatggtttctttaacttctattgagcttctgttgcagatattggacatgggcgtatcttctaacgatgtcgtcaccattagtatattcttcctgctaaaaataaatatcaaaccctgaagcctgaaaaaac

SEQ ID NO: 429342 - DNA, 1602 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtgtttttcatgcaccatctcactgagacctcaacaaagtttttatgagttctgtctctggcgtggtctaatgtagcagcaccattactgttcctgagtaaaagcatcccgatcttgggtttttggtatcagtgtgaatttctgctcaaaagtagcaagatctcttggacagtggctgcttccatgtcaggggctgaaggagtgaagatggtcctggaacttttctttgcagagaagcaagcaggggatgccttcaaagttctgatggagctgaacaaagaagccagcttacagcttactggccaaggtttaacaacttgagcatcaaaatggaaaatacaaattgtaattaattaaaacaagtagactgtgaa

SEQ ID NO: 429343 - DNA, 266 bp, Homo sapiens
gagtttacaaaagattttgcaccagttatagtggaggcttttaagcatgtttcaaggtatgatcatagttttgggtattaggtaatctgttttaaatgtaccatatgtccttttgctaaaatttgccttaaactattaaaataaaaagtagggaatatagttttttgatgcttttatttgaaaagacttccctctacatggcatttataaatgtattaaatgccttctctgaaggaaaaatattttttgaactgttgctaaggtgg

SEQ ID NO: 429344 - DNA, 2414 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaa

SEQ ID NO: 429345 - DNA, 3541 bp, Homo sapiens
gagttcaattagaaagtcgaacaccgaccgctgttacgggtccgcgttgagggtcacaggagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429346 - DNA, 1935 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429347 - DNA, 1727 bp, Homo sapiens
acatttcaaaaagaacataaaactttattaagaacatcttatactgtcatcagatacagccaaagaagaacgggtaaacaaacagggaaagttcatcttcccatgtgctattgccacctcagaacagactcctgtgtggatggctggaacaacagttggcacccacgcgtccggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaagaggaa

SEQ ID NO: 429348 - DNA, 1053 bp, Homo sapiens
tgccggccgggcgcgatcttgctggtttgcggccggtcttggatgaagcggcggccgtggtgagagcgtggggaagggtggggtgagggggcgaggccgcagctagggcggcgaaactctcctcccctcggccccaccgcgtgggacggcgtgaacgtggtgtcggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaaatattggacatgggcgtatcttctaacgatgtcgtcaccattagtatattcttcctgctaaaaataaatatcaaaccctgaagcctgaaaaaac

SEQ ID NO: 429349 - DNA, 814 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggagatattggtatcttgatggacaaacactactaataatcatatgtgttggcattgtgttccctcttgcacttcttcccaaaataggtaagtctttatagagcacattatt

SEQ ID NO: 429350 - DNA, 584 bp, Homo sapiens
aaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcct

SEQ ID NO: 429351 - DNA, 392 bp, Homo sapiens
tgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 429352 - DNA, 1976 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgatgaacaactaaagcccagagaggtgaagtgacctgtcacagaattaaagacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcct

SEQ ID NO: 429353 - DNA, 1934 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429354 - DNA, 1697 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctct

SEQ ID NO: 429355 - DNA, 1701 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 429356 - DNA, 1910 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctct

SEQ ID NO: 429357 - DNA, 1336 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 429358 - DNA, 1647 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 429359 - DNA, 1235 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaaggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 429360 - DNA, 1249 bp, Homo sapiens
  misc_feature (913)..(913): n is a, c, g, or t
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagcagtgggccgggcttataatatgcttaccaacccatggcnttttttttctccccccccaaattttccttcctccccccttttttcccccctttttttggggggggcccccccccccccccaaaacaaccctttcttcctcaacacaaacgcgccccccccccccccctgtgttttttttttttcccccccccagccacaacacgacccaaccacacccctcccgccgtccttctctcccccacaaccaaacccacggtctcttctttcgctcggccgctggcggggggggggggggcccccccccccacccacccccagccacccccgacccgcccctcagagccagcaacacacgccgcgcctctcgtctatcaa

SEQ ID NO: 429361 - DNA, 1881 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429362 - DNA, 2029 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429363 - DNA, 2179 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagtgatgggatgagcggccctaggattatgtactcactgctgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429364 - DNA, 1950 bp, Homo sapiens
tctctccccactccattcccatcctatcttcatctcttgcagtcacaaggaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429365 - DNA, 1720 bp, Homo sapiens
tccaagctccctacaagaacaatggcagaggctattttgtgattactcactgaagagaaaaattgcactttcacatcatcgtacagagatggactgtcatatacattagttaatacaccggctgtttcaatgtcatgcagtatctgtgaatgtacacatggaattgagaactacaaacctagataacgataacaaaaggtccttttcacttatcatgacttcctatatttatcaagtacttttggtctcacagcccaatcactacatgcatagataattatttataatcttttctagttgcaatactattgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggcttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429366 - DNA, 1329 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactgg

SEQ ID NO: 429367 - DNA, 1003 bp, Homo sapiens
aaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaaaaaaaaaaaaaaaaaaaaaaaaaaaaaaaatgtgtgggggggcaggaggccgacgaagaaaaggtttgtaaaagccacatctgcgtgggggcgccggcggggccaatgaaggtgaatttcaacactgtggcgcacaccgcgtctgccacaaaggggaagcccctcggcacacgacaacagcggtcggcgtttcctcccccaaataaaaaaacgcgcggggcaacccgggtgtgtttgagacaatcccagggggcttctcgggccctcgctgggctcacccgggtgccacggaccgtaacgcgcgcgcgcggggggggc

SEQ ID NO: 429368 - DNA, 1066 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatgga

SEQ ID NO: 429369 - DNA, 1313 bp, Homo sapiens
aggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccat

SEQ ID NO: 429370 - DNA, 296 bp, Homo sapiens
gcggcccctactactactatacgggtgttagaagacgacagaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttaaaaaaaaaaagtcgtatcga

SEQ ID NO: 429371 - DNA, 1247 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429372 - DNA, 1649 bp, Homo sapiens
  misc_feature (1329)..(1329): n is a, c, g, or t
  misc_feature (1339)..(1339): n is a, c, g, or t
  misc_feature (1341)..(1341): n is a, c, g, or t
  misc_feature (1346)..(1346): n is a, c, g, or t
  misc_feature (1349)..(1349): n is a, c, g, or t
  misc_feature (1354)..(1354): n is a, c, g, or t
  misc_feature (1357)..(1357): n is a, c, g, or t
  misc_feature (1359)..(1359): n is a, c, g, or t
  misc_feature (1373)..(1373): n is a, c, g, or t
  misc_feature (1377)..(1377): n is a, c, g, or t
  misc_feature (1467)..(1468): n is a, c, g, or t
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttaaaaaaaaaaaaaaaaaaaaaaaaaagaaaaacataaaaaaaaaaaaccgggggctttttttcgggggggggaaaaaggggtnttgaaggggncnggggncanagggntcngnaccctttttttgcncaangggggaaatcggcggggggcccccaaaaggagggcggaataaaatccgagaaaacgcgggttacccgcgtagtgtcgtctccgacaaacnnccacgagacacacagcaacgccgacacaaccagcgcgacacacaaagaaagaaagcgacgacacgcagatacaaggaacaacacacatcaaacaacacaggcgacacagacagctcacacacgacacacaacacaaagaacacgaaaccaacacacatcgagacacaacacagcgaagaca

SEQ ID NO: 429373 - DNA, 1343 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggcctcaatccactaattccttgcgctctccgctgggcccgctgtctgttctccgacgcctacccgggacgcctccctgggatgcttctggcgcgcagtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429374 - DNA, 1549 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaagggtgagaatcgtcctagtcaaggcataggctgctggcctggggtagtcaaggcatgggctgctggtctggggaggatgcgggcggaggatgtggggcgacaaacctggctacgtccgccgggaaaatggggtaggggacgccgggtaccgtccttctaagtggggcgcttgcccccaagacttgggatcttattgggttacctacagcctcaatccactaattccttgcgctctccgctgggcccgctgtctgttctccgacgcctacccgggacgcctccctgggatgcttctggcgcgcagtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429375 - DNA, 1160 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429376 - DNA, 2365 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgggtcagacgcgggaaggcgggtcagacgcgggaaggcgggagttgggtcgggagagggcgccggatctgtgggcccatgagcggttgtcccctttctcgccacacggcggcagccacaatctgactaacattcttggcactcagagcccagggtctaccctgagcttgtgcgtccgagttgcgttttgtacagtagaggttctgtatcccttacccgaaatggttgggaccggaagtgtttcgggttttttcagatttcggaatatttacatatacatggatatcttgggggatgggacctaaatctgaacacgaaattgttttgtttcatatacacgcaccttatgcacatagcctgagggtaattttatataatagtctgaataattttgtgcatgagacaaagttttgactgcgttttgactacagtctcccccaccccccactatgaagtcaggtgtggaattttccattttcggcctcacactggcactcataatttcagatttgggattttctaattaaggatggccaacctgtactgttaatcacattattattccatttggtgatgaggaagcaaactctaatggtgcagactctcgagtagcagagctggacttaaatgctgtggtgccaccttttagtgacatgtctgcatgacagcagtggctgcagtctctccagggtgtttcagctaattttggttgggggggggttggtggttaaatttttggtgagatcctggtgttccccaaaggtgttgactgattcagctctgctgcctcatagccttcctgagttccagctacagacctggggtctcgtgttcattcttggggttccagtgactaaactgctaaaatggttcacctgagagcaagaagcacactgccttgggacattttcattcactgcatcccatctagttgtgcccagtgtagaccaaatgtcatcatccaaaccacacgggacagaggcctgcatgcgtcctgtttggcaaacagctgcccagccagtgggggagcagttcatgcttaaactaccaccccctccaggtgtcttaggcacgctggtccttaggagaagggttgaccttccactccctcttgcaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429377 - DNA, 1460 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttaaaaaaacacaaaaaaaaacaaataaacacaaaaaaacagggggggcccccctaaaagttcccccccggggggcccccagattttcgtccctccccccggcttttgtgtggtcaccggagggtggcccctcctaataggggcggtcgctttttctaggcctcgggactgttgcgccccgcgcttcatccaaggctccgggcagtgggcgacaccgtgcccaccctgggggaccccttcgcgcgaaggccaccctcactctgctggggcggagccccatcatgtgggccgcgcttctcccca

SEQ ID NO: 429378 - DNA, 1409 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggcctcaatccactaattccttgcgctctccgctgggcccgctgtctgttctccgacgcctacccgggacgcctccctgggatgcttctggcgcgcagtggtcctcgcggaggtgatccaggcgttctccgccccggagaatgcagtgcgcatggacgaggctcgggataacgcctgcaacgacatgggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttacaaaacaacgtccacacaagaaccaacacaacacacaacacatacaccgagggggggccggtaccaattggcctaatgtgagcgattccactcctggccgtgtatccacttcttccggggcctggtttccttatcgctgtggcaccccttcgc

SEQ ID NO: 429379 - DNA, 1036 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaaaaaaaaaaaaaaaaaaaaaaaaagaaaaacataaaaaaaaaaaaaaaataaatctaaaatttcagcataaaatttctaatccatttcaaccttaccctatataaccatatttttatctattcatacttttttcccttcacataaagtttttttttacccccaatcttgctctctttattcattctaggtcaccgacctttattttttacacttcaacattgttcatatttcgacaatatgttcgcatttttttatatctttgttacacaaaggcttatttccatcatttcatacccttataacaccttctagtgcgaatgtccggcgtataccactaataatctttcgcctaacatcaccttattccttctctcctttatcactgatcttacttaatggcctcttatgcg

SEQ ID NO: 429380 - DNA, 736 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaatggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429381 - DNA, 754 bp, Homo sapiens
acgaccggccggcaagagacccatctggaaaggttcctggaatgggttagggaccccttaccgggtaaaacggtcccgttgaatgccagaaaaaaacccagggccaccgtctctttctagtgaattccctagcctaatcttatctcttaaagacctctcttttcaggatggtgcactctcagcctcgtgccgaattcggcacgagctcgggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgactta

SEQ ID NO: 429382 - DNA, 1290 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttaagccttggtgtcagtctcttgcggacctgacaacccccatctc

SEQ ID NO: 429383 - DNA, 1745 bp, Homo sapiens
  misc_feature (1425)..(1425): n is a, c, g, or t
  misc_feature (1435)..(1435): n is a, c, g, or t
  misc_feature (1437)..(1437): n is a, c, g, or t
  misc_feature (1442)..(1442): n is a, c, g, or t
  misc_feature (1445)..(1445): n is a, c, g, or t
  misc_feature (1450)..(1450): n is a, c, g, or t
  misc_feature (1453)..(1453): n is a, c, g, or t
  misc_feature (1455)..(1455): n is a, c, g, or t
  misc_feature (1469)..(1469): n is a, c, g, or t
  misc_feature (1473)..(1473): n is a, c, g, or t
  misc_feature (1563)..(1564): n is a, c, g, or t
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaaggcctcaatccactaattccttgcgctctccgctgggcccgctgtctgttctccgacgcctacccgggacgcctccctgggatgcttctggcgcgcagtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttaaaaaaaaaaaaaaaaaaaaaaaaaagaaaaacataaaaaaaaaaaaccgggggctttttttcgggggggggaaaaaggggtnttgaaggggncnggggncanagggntcngnaccctttttttgcncaangggggaaatcggcggggggcccccaaaaggagggcggaataaaatccgagaaaacgcgggttacccgcgtagtgtcgtctccgacaaacnnccacgagacacacagcaacgccgacacaaccagcgcgacacacaaagaaagaaagcgacgacacgcagatacaaggaacaacacacatcaaacaacacaggcgacacagacagctcacacacgacacacaacacaaagaacacgaaaccaacacacatcgagacacaacacagcgaagaca

SEQ ID NO: 429384 - DNA, 1311 bp, Homo sapiens
gggtggggtgggctagttttaataggtccaggcgattagtacctggcatccttaaccacctacagtttgagaagggagtgggtgataaaagcctggaagcggagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaagggtgagaatcgtcctagtcaagtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttctgccgcccatgaccctgccaccccatgggcctgctgctggtggcagcgtggccgcctcctgagagttggccctcccttgtgccactgccaggggaggaaaggccttgatgttccagacaataataaatgcgcctgtgacttaagccttggtgtcagtctcttgcggacctgacaacccccatctc

SEQ ID NO: 429385 - DNA, 1213 bp, Homo sapiens
gctcagaacacttgggtcacttgcctctggtcactcaactctctagtatctggcagaactgggcttggagcccatttttttttctttcctttttttgtctttgttcccttttttttcagcctacaaaggccatgttgacttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccaggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatca

SEQ ID NO: 429386 - DNA, 420 bp, Homo sapiens
aagcgcacgatggcgcgtcctgaagagaaggaacggcatgtgtgaagatcctcaagcgaagcagagggagtgtgtttccttctcgccttagtttgaccaaatctcacgacgcctggactattcgggccacaggctgcccatcctgagttaagctaaactgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggacgcgccatcgtgcgctt

SEQ ID NO: 429387 - DNA, 424 bp, Homo sapiens
gcgagctcggtacccccccgactagcccgacagcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcatagtgcggcacaagtccgcatggggatcctgtacgagacgacatgcagcctg

SEQ ID NO: 429388 - DNA, 3444 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429389 - DNA, 3372 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429390 - DNA, 3879 bp, Homo sapiens
  misc_feature (3878)..(3879): n is a, c, g, or t
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttcaaaaaacacaaaaaaaattcgaggcaccaacgcccgagagccgacagacacgccgccactgcaacctggccccggccctacgtcgccccggacccagctccccggcacacacgggccaaccccgccggtctccctcatagtgacccgcacaacccccaacaccaggtcaccggctacaaagcggcaacacacctccacacacccccgcccccccagcaccacgcgcgggcacccaccacaccacagaccgagcacgagaccgcacaacccgacaccaaacacccgacacaaccgagccgacagccagacgaaccacgccgacacccacgcagacagcaggaagacgaccacacacgcagaggtcgagggagacccacctgcagcgcacacccccgcacgagaagcgctacccgccccccccggcggaaacaatnn

SEQ ID NO: 429391 - DNA, 3024 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatca

SEQ ID NO: 429392 - DNA, 2189 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429393 - DNA, 2251 bp, Homo sapiens
gagagatggggatagttatgactgaggttttctcggtgatgaggtttatgtgttatttgtggtgatgagccccttgtgtgtggtacatatgtagagggagtatagggctgtgactagtatgtttgagtcctgtaagtaggagagtgatattagatcaggagaacgtggttactagcacagagagttctcccagtaggttaatattggggggtaaggcgaggttagcgaggcttgctagaagtcatcaaaaagctattagtgggagtagagtctgaagtccttggaagaaagtccattggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429394 - DNA, 2133 bp, Homo sapiens
aagcgcacgatggcgcgtcctgaagagaaggaacggcatgtgtgaagatcctcaagcgaagcagagggagtgtgtttccttctcgccttagtttgaccaaatctcacgacgcctggactattcgggccacaggctgcccatcctgagttaagctaaactgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429395 - DNA, 3633 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttctttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactggaa

SEQ ID NO: 429396 - DNA, 3520 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgcgacatccggggacgtgcggcccagtacttttggccctccttgcagttcggttctcctcccttctcccaagctcctacatggtgtagactagaatgtggtcctcaatacagaataaagac

SEQ ID NO: 429397 - DNA, 3286 bp, Homo sapiens
  misc_feature (3108)..(3108): n is a, c, g, or t
  misc_feature (3112)..(3112): n is a, c, g, or t
  misc_feature (3115)..(3115): n is a, c, g, or t
  misc_feature (3123)..(3123): n is a, c, g, or t
  misc_feature (3127)..(3127): n is a, c, g, or t
  misc_feature (3132)..(3132): n is a, c, g, or t
  misc_feature (3136)..(3136): n is a, c, g, or t
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggnacgnttnggtgcgtntggncaggntggngcggcagttaggggctggcaggcgggagttgagcggtggaagaaccgactgggtctggtcacccaagttggatggggggctgggatggccgaattggagggactaggccgggggcacgggtggaaatgtaaaaattggggcttctcgcta

SEQ ID NO: 429398 - DNA, 3012 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactttgcatccagagacactttgcatccagaggacactttgcatccagaggacactttgcatccagagacactttgcatccagagacacttgcatccggtatcctctaga

SEQ ID NO: 429399 - DNA, 3217 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccaggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429400 - DNA, 3662 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaaagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttcaaaaaaaaaaaaaagaaaacagaaaaaaaaaaaaaaaaaaaaaaaaacggggggggacacatctataccggaggggggagaaaaaaagcggcaaagaaaagggcacacgggcaccacaaagcggacaacacggagccacaaggcttctagaacacaacaggggaaaaacacggcagagaccccaataagaggcacaggataaaatgagaagaacaccagagagatacacgcggcaataaagacgcgaggaacaaacacaccaaaaaaaagacaagcgataaacagaagaacaagagaaaaagggagacacaagaaacaagcaaaagagaagcacagagaggagaaaaaaaagaagaaaggaggaaagagaaagaagaagaagagaaaaaagaacagacgaagcagcaccaaagaaagaaaatacgagcaaggggaaagagagcgagaaagacggaagcagaagcagagaagaaaacgag

SEQ ID NO: 429401 - DNA, 3406 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccaggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttctttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactggaa

SEQ ID NO: 429402 - DNA, 3781 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtaagcctcctttgtctggggggatggaggctgctaggagctgggagagactggaagaagtggcaagtcctgagaggggctttctggagcctctggccatctccccaagaaaagaagggagaggcactggaggggatttttcagatccaaggaatttgccccagaagggtctggggtctaagtggggtttcacaggcctagcagatccttctgttttgagaaaggagtgagaagggccctatgggatttctccagagccccagatgtcggcacagggtgaggagaaggcaggctgagagcgctccatcatccttttcctcttcctctcgcccagcaggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429403 - DNA, 2797 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccaggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatca

SEQ ID NO: 429404 - DNA, 2543 bp, Homo sapiens
  misc_feature (2481)..(2481): n is a, c, g, or t
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagaaagagtgtgngcccggtgggccttccaccgtatctgtttcggggccactttggttcccctgccttgtttggc

SEQ ID NO: 429405 - DNA, 3065 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429406 - DNA, 2638 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttgggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatca

SEQ ID NO: 429407 - DNA, 2946 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtaagcctcctttgtctggggggatggaggctgctaggagctgggagagactggaagaagtggcaagtcctgagaggggctttctggagcctctggccatctccccaagaaaagaagggagaggcactggaggggatttttcagatccaaggaatttgccccagaagggtctggggtctaagtggggtttcacaggcctagcagatccttctgttttgagaaaggagtgagaagggccctatgggatttctccagagccccagatgtcggcacagggtgaggagaaggcaggctgagagcgctccatcatccttttcctcttcctctcgcccagcaggtctgaatgactgggatgatgatgagatcctagcttcggtgctggcagtgtcccaacaggaatacctagacagtatgaagaaaaacaaaatatcttttcatagtccaatgtcaatatacttgagacccattaccttttatatccctaaacagtatcctattagactgcctattaagaattatttcattaccctacatataaataaagttatcaaatttcctaagcgtgaatcagcagtccgtccgactat

SEQ ID NO: 429408 - DNA, 1849 bp, Homo sapiens
gttgctctttgggagtacctgctttcctgtctccttttttttctggggcctgtgggcctacctcgctgagcctgttctggctcttgggcaggttcagtgtgttattgcacatccctgttcctctccctccttgcagtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtcagtgacttgcccacagggaatgtgctgggagttaggaggcacgtcctgggtcctgggtcctggatcctgggtccctacctttgactgtccgtctgcttcaggtacgtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429409 - DNA, 1860 bp, Homo sapiens
gctcagaacacttgggtcacttgcctctggtcactcaactctctagtatctggcagaactgggcttggagcccatttttttttctttcctttttttgtctttgttcccttttttttcagcctacaaaggccatgttgacttgtaggagtcaggaaaactgaattcagagttgactctgtcacagactgactctttgtgaccttggacaaaccacaaactccccctgaacctcagtttcctcatgtggaaagcaaagggggtgtgggaatcaatagcatttgaggccaacctgtggaacttagaatgttgttgatttctctgagtggccacgtgtaccctagacaaagtcatctgcccaagaggcctgtggatgtgttcctctcacctgcactctcttgttcttcaagtctggccctgcctgccatatttttccatgaccccgttctagcctacaagggcaagaactctccaggccttggggtagaaaagggaatttccctggtcccccagttcctcctccccaaaggatgttctatgattcagagctcttctctggcatctctgaccctagctgctgctttcttctgcccccacagctgaccaggtgtatggagaccaggacatgcatgaggttgtgcgaaagcattgcatggactatctggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429410 - DNA, 1060 bp, Homo sapiens
tagcggatccctcttcgactagcctgacagccccgactagccgttgccccgactagccctgacaggccccgactagcccgactgagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 429411 - DNA, 2064 bp, Homo sapiens
ttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattggttggtgttgcaattgttgtggcggcggcggcggcgattttgcccacgtacttccgagtaaggggcggggctgtgccctggcgcgcgtgcgcagcgccccggggccccacccggtagtgcaagaacctgcgagggggcggagcgaagaggtgcttgttttggttctgtttcctttgaagcagaaggccggaacaagcgtagcaataaacttgctggacttggagagaaggctaagacaaactcgccgcactgccttcatcttggactttacatccgggttctcctctcggcgtgacccgcgcgccgccaccgccgccgccgccgccgccgccgcctccgccgccgagggttctcgaaccggtgccgcgatccctttatccgggtctcgccgttcccgtcgtgcctcgcgcactacactagccccctcatccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagacttctgcagtgggtaggtgagggaaagatggtgcctcattcgagcctgcccaacctggcctgctgtggatgctccctccttctctttctctgcagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccaggggtgagtgggtccctgtgcccagaatggctgctggatatagaggtcagaaacctctgttggagtctgttttgcccctaactcacaaaaatatcctgtctcctctctcccctgaggtctcacccttacaaa

SEQ ID NO: 429412 - DNA, 4600 bp, Homo sapiens
atgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctgtgatgtttctctggcgctttactggcctgggcacacctaccaatcttctaggatttgactggttccattacatttccttttggtataagcttcacagaaaagctgacacttcctctacagagatggaccaaaacataagcaatttcagtctacagcatgtgcatggttgtcagtgcattctaaatatttctatgtgaggaatggtaccttctgaaactgcctttccagtctttaggcaatgggataggaaagaaagaatgaaacacaaatggatttgtatgtaacatttccttaattaaatgcagtaggctgtgccccagaggattccagacagtggctggctgaggtgggtggggagcttttccttgagactgttggtcctaagaagccagcccttttggagaggcagctgcaaaaaggtgcacgcccatctcaccgacaaaactgtggaacagaaggccaccaagtgctgtggggaatcatgggtttcagtgctgagtgaaaatctatacctaaaaatca

SEQ ID NO: 429413 - DNA, 3773 bp, Homo sapiens
atgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaagtatgtctatcttaattattaaattattcataattcagaaatatatttacataatgtatatagtatacaaacagtgacctaccacctactttgctttgaaaagaaaaataaatgggaaacaacttgtatcatctaggtatttttctgattgtccttattatttggaatactgtgcatacagtaattgtcttatggatatactcatggcatgcagattaagaattaagaaggtaataccaccataataaatcggactatcttttactgtaaaaatgttcttgattcagttatttcctaatctaagcacaattatttcctgtgagttttatttaaatattc

SEQ ID NO: 429414 - DNA, 2065 bp, Homo sapiens
atgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaagggaccatgaaaaacagcaacacaatcatagtaaagcacgagtggggcaggcagttacattctgactggacgctcctcctcagcggcccggacattctctgcagctccaaggaggaccggtcggcctggcccacggccgtggcagtgccaagtgctgacgatacccaggccaaggcccaggagaaacttgcgttgctcaaagccctttcacataagactggggaccatgtccgaagtgaaaacagctgtctgttgttcccatttttcatcagcacttccggatccgccccacacgatataatttgattcaactggtaactcccgttgccagatgaaatgtctctgatggacacttgccacgctttggtaatgcagaagctgtcgtgtttgcgaagtgtgctttgggggcatcactcgataaattaagcttttgaagagttgaagatatttgtgccggaaactgtggagaagcaacagcctgacagtgcctatttctcctcggctgttatttcaaaatgcaagacgtaaaccacatcccaagttatttttttagtgcttaggtcctctgggggaggggagaatgccccaggcaattgatttgagacaatatattgcacacatttataattttgaatttggtgaggagtggaatataaatttggaactcaaattaatc

SEQ ID NO: 429415 - DNA, 1831 bp, Homo sapiens
atgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagcgctctaaacatcctctacaagagtgccttatgctggacttttacttatataccctcaggatggcttcaatggcaa

SEQ ID NO: 429416 - DNA, 2355 bp, Homo sapiens
ttcattcactcattcattcattcatcatttatttttttaaaagatatttattgagagctgaataacatgtatgagattcagggccaaaagtgtctgaggaaagtccatctggaatgcaagggggaagaagctatctgctggctcctgcctggcattgttcagagtcttgccacataggaaccccctgtgcttctggtcaacgtaagcttgaaaaaggggtggccctgcgtctcctgcctctgtgagggcagggaaagcccacggtaggggatagaggtgtggggaggagggcactcaggcctaggagtccaactggctgatagcattagaggatgctccattttacattatggatggtaactcagagctcacccagctcaccctcagactcactgtgacggtggttgtttcatttacaaccttgtatgtaacaggttgcctttttgttctaaatcagctgtcctgatgattctctcatgccttgagcatgttttctgtttggggattgctcatctccagctcagcagttggttgtgctgcatggccttgtagacccaaatcctcagacctcccatccagggaaaaccaaactgcatttgtagttttgttcctaggtcgtctattttttctttcatggaggataatttgatatctttttcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctgtgatgtttctctggcgctttactggcctgggcacacctaccaatcttctaggatttgactggttccattacatttccttttggtataagcttcacagaaaagctgacacttcctctacagagatggaccaaaacataagcaatttcagtctacagcatgtgcatggttgtcagtgcattctaaatatttctatgtgaggaatggtaccttctgaaactgcctttccagtctttaggcaatgggataggaaagaaagaatgaaacacaaatggatttgtatgtaacatttccttaattaaatgcagtaggctgtgccccagaggattccagacagtggctggctgaggtgggtggggagcttttccttgagactgttggtcctaagaagccagcccttttggagaggcagctgcaaaaaggtgcacgcccatctcaccgacaaaactgtggaacagaaggccaccaagtgctgtggggaatcatgggtttcagtgctgagtgaaaatctatacctaaaaatca

SEQ ID NO: 429417 - DNA, 1473 bp, Homo sapiens
gtttacaagtattgcaaacaattactgctagcaaatgctttgtatttgtctctaagatatcctgttgtttgaatatgccattttttttcaaacacgtagtaaagcaggggctgtcattttgtattatattctactgtgaaatgtgtttaaaattctgcgtattatgaatatgcttctgaaactgaaataaaaaggttttgctcttcagtaccaaaggaggatactttaatcctcctttgtttaatttggggagggaaatagacatttattcaaatgagtctcagaacagtgcctcttggtcttgcagttgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctgtgatgtttctctggcgctttactggcctgggcacacctaccaatcttctaggatttgactggttccattacatttccttttggtataagcttcacagaaaagctgacacttcctctacagagatggaccaaaacataagcaatttcagtctacagcatgtgcatggttgtcagtgcattctaaatatttctatgtgaggaatggtaccttctgaaactgcctttccagtctttaggcaatgggataggaaagaaagaatgaaacacaaatggatttgtatgtaacatttccttaattaaatgcagtaggctgtgccccagaggattccagacagtggctggctgaggtgggtggggagcttttccttgagactgttggtcctaagaagccagcccttttggagaggcagctgcaaaaaggtgcacgcccatctcaccgacaaaactgtggaacagaaggccaccaagtgctgtggggaatcatgggtttcagtgctgagtgaaaatctatacctaaaaatca

SEQ ID NO: 429418 - DNA, 877 bp, Homo sapiens
atgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagaggtatttcccagtcaatagattccttctcattgtttcacgtttaccgtcatttcctcatgattacttaaggcctattcagggcaacattttaatcccaggctgacttcctctgacatcaacacatacgtggctgggcctgacctagacatgaatctaatgtctatattaggattaagtaaatgtgctacaggaacatatcaggataatgtgcttttttttttttttggtggggggtggttatttgttctcctgatacccttcattagctcagaaattcaagaattgattatagcatttaactgttttcagataccctacagtaatgataattatg

SEQ ID NO: 429419 - DNA, 531 bp, Homo sapiens
taagctgaaagttaacatttatgtcaagtagagatagctgaacaaacaatgctcataacttctttttcaaatgtagcatattatattctatatggaactctatatagtagaacaatatctcaatgactaactgtgtaattttctctcaagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagaggtatttcccagtcaatagattccttctcattgtttcacgtttaccgtcatttcctcatgattacttaaggcctattcagggcaacattttaatcccaggctgacttcctctgacatcaacacatacgtggctgggcctgacctagacatgaatctaatgtctatattaggattaagtaaatgtgctacaggaacatatcaggataatgtgcttttttttttttttggtggggg

SEQ ID NO: 429420 - DNA, 3592 bp, Homo sapiens
  misc_feature (669)..(669): n is a, c, g, or t
  misc_feature (1769)..(1769): n is a, c, g, or t
  misc_feature (2739)..(2739): n is a, c, g, or t
  misc_feature (3101)..(3101): n is a, c, g, or t
aaggacagagatttccatctgttttgttcaatgctatgtctctagggcctagaacagagcctgggaccccataaggtgctgaataaataggggttcagtgaattcattaattacatttctgcaagatggggtggcatgttgtcatcttcagccattttttttttcttcgattgcattatatttggaacaggcacgatggtgacatctgtaatcccaactacttgggaggctgaggctagaggattccttgagcccaggaattcaaggctaaagtgtgctatgatcacacctgtgaatagcactgcactccagcctgggcaacacataagacctctctctttaaatgtaaaaaaaaaagtctgcgtgcagtggcttatgcctgtaatcccagcactttgggaggctgaggcaggtggatcacctgaggtcaggagttcaagaccagcctggcgaacacagtgaaaccctgtctctactacaaatataaaaaaaagaaaaaacattagctggatgtggtggtgcatgcctgtaatcccagctacttgggaggctgaggcaggagaatcgcttgaatctgggaggcagaggttgcagtgagccaagatcgcaccattgcactccagcctgggtgatagaatgagactctgtctcaaaaaaaaaaaaaaaaanaaaaaaagatttgatggagctgtctccaaaattaagaagaggatgaaaggagctgacccagacactcaagcagggctaattattccccttttacagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatgggtaagtgtctgctagaatggcctgtggctcagggattggctctgccactcaccacctaagagatcttggtcaggtgcaggcacctcttcgagcctcaatttcttgctttagaaaatgatgacaatcacgatgacttaaaacatgcagggactttgtgggtgcttaaaatgtgtgtttacaaggctgagcgcggtggctcatgcctgtaatcccagcactttgggaggccgaggccggtggatcacttgaggtcaggaattcgagaccagccttgccaacatggtgaaaccccatctccactaaaaacacaaaattagccgagcgtggtggcacgcacctgtaatcccagctactctggaggctgcggcaggagaatcgcttgaacctgggaggtggaggttgcagtgagccgagatggcgctaccgcactccagactggntgacagaacaaaactccatctcaaaaaaaaaaaaagtgtttacaattattccaaggagctgtacctgttctgaccacagcttaccttgctaacaacttctgctacgtaccctcctcatgctggtcacacagccctccttgcagttgttcgaaccctcaggcttttattcccgcctcggggcctttgcattttacatttccaccagtgacgggaacattctcattcccctaattttttcctgagtggctcctctccatccagggtaagttcctcaaagcagttgagtctgacggtcttacctaaaggaggactcacctgaatgccccctcatgccccttttttcccatccttctcccaaccccattcaacatgagccgtccctgcatcccaggccctgcacggagtgctaggatacatcaacaaaccagaaagagacaaagatccctgcccgatgggagccaacagtccacgagaggacaacaaaccatgaaccacaaaaataaggcaattttgtttgcttcaagatgaaaattaaaacacaggaagggaaggccaggcacagtggctcaggcctgtaatcccagcactttggaaggccaaggcgggcggatcacctaaagtcaggagttcgagaccagcctggccaacatggcgaaaccccgtctctactaaaactacaaaaattagccgggcgtggtggtacacacctgtaatcccagctactcgggagactcgggaggctgaggcacgagaattgcttgaacccgggaggcagaggttgccgtgagccaagattgcaccactgcactccagcctggacaacagagtgagactctgtctcaaaaaacaaacaaacaaacaaaaaacagtaagggaagggtgaggtggctcaggtctgtaatcctagcactttgggaggccaaggtgggcggatcacttgaggtcaggagttcgagaccagcctggccancatggtgaaaacccatctctactaaaaaaaaataaaataaaataaaatacaaaaattagccaggtgtagtggcatatgcctgtaatccaagctacttgggacagagtgagactgtctcaaaaaaaccgaaaaaacaaaaacaaaacaaaacaaaaaaaacagagtaagggagatagagactataaagatggagatgtatattgcaattttattttatttctatttatttatttatttttgagatagagttttgctcttgttgcccaggatggagtgcaatggcgtgataccggctcactgcaacctccacctcctgggttcaagtgattctcctgcctcagcctcccgagtagctgggattncaggcatgtgcaccacgccctgctaattttgtatttttagtggagatggggtttccccatgttggtcaggctggtctcgaactcctgacctcaggtgatccacccacctcaacctcccaaagtgctgggattacaggcgtgagccattgtacccaagcaagcaattttaagtggtagtcaggaaaggccccattgcagaaaaaaataaaattgaaggaaatgagggagggaacaggtggataactgggggataagcaggcaggaggaagaggcagtgcaaaggctcttgggtcagaacaagaatttaagctgttcattcaaccaaaaaatgagtgggtagctgggtgtggtgttgcacgcctgtggtcctagccacttgggaggttgaagcaggaggactccttgaacccagaaagtcaaggctgcagtgagccgtgatcgcaccattgcactccagcctgggccacagagtgagaccctgactcaaattt

SEQ ID NO: 429421 - DNA, 1918 bp, Homo sapiens
  misc_feature (1065)..(1065): n is a, c, g, or t
  misc_feature (1427)..(1427): n is a, c, g, or t
cctgggaggctgagctaggaggatcatttgtagtccaggaggttacggctgcagatgagccgtgatatgcactattgcacttcaacctgggcaacacaagccagaccatagtctcttaaaaaaaaaaaaagtgtttacaattattccaaggagctgtacctgttctgaccacagcttaccttgctaacaacttctgctacgtaccctcctcatgctggtcacacagccctccttgcagttgttcgaaccctcaggcttttattcccgcctcggggcctttgcattttacatttccaccagtgacgggaacattctcattcccctaattttttcctgagtggctcctctccatccagggtaagttcctcaaagcagttgagtctgacggtcttacctaaaggaggactcacctgaatgccccctcatgccccttttttcccatccttctcccaaccccattcaacatgagccgtccctgcatcccaggccctgcacggagtgctaggatacatcaacaaaccagaaagagacaaagatccctgcccgatgggagccaacagtccacgagaggacaacaaaccatgaaccacaaaaataaggcaattttgtttgcttcaagatgaaaattaaaacacaggaagggaaggccaggcacagtggctcaggcctgtaatcccagcactttggaaggccaaggcgggcggatcacctaaagtcaggagttcgagaccagcctggccaacatggcgaaaccccgtctctactaaaactacaaaaattagccgggcgtggtggtacacacctgtaatcccagctactcgggagactcgggaggctgaggcacgagaattgcttgaacccgggaggcagaggttgccgtgagccaagattgcaccactgcactccagcctggacaacagagtgagactctgtctcaaaaaacaaacaaacaaacaaaaaacagtaagggaagggtgaggtggctcaggtctgtaatcctagcactttgggaggccaaggtgggcggatcacttgaggtcaggagttcgagaccagcctggccancatggtgaaaacccatctctactaaaaaaaaataaaataaaataaaatacaaaaattagccaggtgtagtggcatatgcctgtaatccaagctacttgggacagagtgagactgtctcaaaaaaaccgaaaaaacaaaaacaaaacaaaacaaaaaaaacagagtaagggagatagagactataaagatggagatgtatattgcaattttattttatttctatttatttatttatttttgagatagagttttgctcttgttgcccaggatggagtgcaatggcgtgataccggctcactgcaacctccacctcctgggttcaagtgattctcctgcctcagcctcccgagtagctgggattncaggcatgtgcaccacgccctgctaattttgtatttttagtggagatggggtttccccatgttggtcaggctggtctcgaactcctgacctcaggtgatccacccacctcaacctcccaaagtgctgggattacaggcgtgagccattgtacccaagcaagcaattttaagtggtagtcaggaaaggccccattgcagaaaaaaataaaattgaaggaaatgagggagggaacaggtggataactgggggataagcaggcaggaggaagaggcagtgcaaaggctcttgggtcagaacaagaatttaagctgttcattcaaccaaaaaatgagtgggtagctgggtgtggtgttgcacgcctgtggtcctagccacttgggaggttgaagcaggaggactccttgaacccagaaagtcaaggctgcagtgagccgtgatcgcaccattgcactccagcctgggccacagagtgagaccctgactcaaattt

SEQ ID NO: 429422 - DNA, 2371 bp, Homo sapiens
cgggggtgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggtgagcgttccctctgcgctggactgcagacttcagagcaccctgcaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaaaaaaaaac

SEQ ID NO: 429423 - DNA, 2980 bp, Homo sapiens
  misc_feature (669)..(669): n is a, c, g, or t
aaggacagagatttccatctgttttgttcaatgctatgtctctagggcctagaacagagcctgggaccccataaggtgctgaataaataggggttcagtgaattcattaattacatttctgcaagatggggtggcatgttgtcatcttcagccattttttttttcttcgattgcattatatttggaacaggcacgatggtgacatctgtaatcccaactacttgggaggctgaggctagaggattccttgagcccaggaattcaaggctaaagtgtgctatgatcacacctgtgaatagcactgcactccagcctgggcaacacataagacctctctctttaaatgtaaaaaaaaaagtctgcgtgcagtggcttatgcctgtaatcccagcactttgggaggctgaggcaggtggatcacctgaggtcaggagttcaagaccagcctggcgaacacagtgaaaccctgtctctactacaaatataaaaaaaagaaaaaacattagctggatgtggtggtgcatgcctgtaatcccagctacttgggaggctgaggcaggagaatcgcttgaatctgggaggcagaggttgcagtgagccaagatcgcaccattgcactccagcctgggtgatagaatgagactctgtctcaaaaaaaaaaaaaaaaanaaaaaaagatttgatggagctgtctccaaaattaagaagaggatgaaaggagctgacccagacactcaagcagggctaattattccccttttacagatgtggaagactgaggcctgttgaaagtgcagagctcagccctggcaccctctgttcccaagagctccatgcaggtgccacaggatggagaagaccttgctggccaaccttgaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaaaaaaaaac

SEQ ID NO: 429424 - DNA, 798 bp, Homo sapiens
gtaagtgaaggtctggggcttagcatcccctgggggcccagaccaaatttaacaggactcaatctagtcctatgcccagtccctgcatctgttctaggcccggtcccttcaccataggccccgccctccacatgagggttggtcctggccctttccctaggccccgccctccacacgagacttgttcctaggccacgcccccaccagccttggtcccagcccctttccctaggctacgccccttcgccataggccccgccctccatacggggcgtgtggtcctggcccctctccacagaccccgctgtcgctcagtcctaagccccgcccctgcatttgtcctaggttccacctctgccctatgccccatctacagccccaaaccctgatcagaccctccccctccgcaggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggtgagcgttccctctgcgctggactgcagacttcagagcaccctgcaggttctaaccggatcccccaaacccagcctgtcccaggaggggagcctctcgccacgcctcccggagccccacccaaactgggacggctccactccaggaaggttctcaccccaagcaaacgctgcatccagcggtattgataggaacagggccg

SEQ ID NO: 429425 - DNA, 2323 bp, Homo sapiens
cgggggtgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaaaaaaaaac

SEQ ID NO: 429426 - DNA, 1963 bp, Homo sapiens
cgggggtgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagagacccttgccctccacctctgcaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaaaaaaaaac

SEQ ID NO: 429427 - DNA, 1833 bp, Homo sapiens
tggttgaaattcaaaactgcacccggataggttgttataccccattattggaatgagtggatggatcaggtgggtggtagccgatgaagctctcacccccgcccattcagcaatcttccctgtgtattcccattgacccctcttgtatgacctctagaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaaaaaaaaac

SEQ ID NO: 429428 - DNA, 1020 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429429 - DNA, 1054 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttcaaaaaaaaaaaaacatatggccttgatggcctca

SEQ ID NO: 429430 - DNA, 966 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429431 - DNA, 951 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429432 - DNA, 982 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429433 - DNA, 1045 bp, Homo sapiens
atcgaatgaagaacaccagaaattatttctgtggacattggctgaacaattaacacattttagcactgaagaaggaacttcaacctagtctttttacgcacaaaaggagacaacattttcaccatatttcagaaagactcattctattaaaggaaagccaagaaacacacttgtaagcgagtagggaggatttttctgcaacataagctatttaaggaggtattagtaaaagatgattaattgaatttaattaaagctttaaatctaacatcagtgacttaggcctttcttggcttggttcacaggctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429434 - DNA, 914 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacaggctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429435 - DNA, 913 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacaggacagataggcatggacccttcaagtggacagcttgtgtcaggaggggtagcagaagaagctaaacaagctcttaaaaacatgggtgaaattctgaaagctgcaggctgtgacttcactaacgatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttc

SEQ ID NO: 429436 - DNA, 431 bp, Homo sapiens
gagctgtggggcagaggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagtaagttattttccacatttaaggttcccttttctactacctttttaatgttgaagagcattaagaatccacttgcctgatttgttttatagagattaacagataaatgttttttaaactacttactgcttgatttaacatagtttttgat

SEQ ID NO: 429437 - DNA, 1106 bp, Homo sapiens
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaagtgctggattcgtcattacaatcttcaaattggaaaaaaaaaaaaaaaaaaaaaaaaaaaaaaaaaaaaaaaagggggggggggaaaaaaaaatcccccgggggggccatgttttacgtgatcaccggttttttgtgaaaaggggggcccatatagggagcacgattataaaaggcaggacaggggcgcgttatacaaggcgtgagggaaagggcagattggggacttggggaaggaccctactctgtggggtgggcaattgggacactacttagaaagaataagtcatagtaatataattaggggtaagtggtcaccaccgcattgtggacgaaagtggtgggtaatatagatg

SEQ ID NO: 429438 - DNA, 544 bp, Homo sapiens
attataatcaatgttttcctttacagggcttcttgtatgcatatagtattagtaccattattaaaaccacaatgaatctctacatgtccatgcaaaagccaatgaccaaaacctcagttaaggcattgtgcaggcttgttgaacttctcaagcttaccaaatatggatgaatcaataaagcattaatcgttatatatgtttttgaagtttatattagtggagcagtattttatgtattttttgatccatttttttattcaacattttgttttttactcagcattttgtatttgagggtatccatgttgggatgagtagcacatctattttcattgttgtgtagtggatagacttcgggttgtttccggtttttgtatcataaacaatgttgccatccttgtatgtgtttcttggtgtacttgtgcaggagtttttgtaaggaattatatacctaaagttggttactggattatgtgttacgtatatgttcaccttttcaagatgatgtcacattgtctctatagacagactatatatatgtgtg

SEQ ID NO: 429439 - DNA, 5811 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429440 - DNA, 6132 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaatttaaaaaaaaaaaaaaaaaaaaaaaaaaaaaaaaaaaaaaagggggggggggaaaaaaaaatcccccgggggggccatgttttacgtgatcaccggttttttgtgaaaaggggggcccatatagggagcacgattataaaaggcaggacaggggcgcgttatacaaggcgtgagggaaagggcagattggggacttggggaaggaccctactctgtggggtgggcaattgggacactacttagaaagaataagtcatagtaatataattaggggtaagtggtcaccaccgcattgtggacgaaagtggtgggtaatatagatg

SEQ ID NO: 429441 - DNA, 5671 bp, Homo sapiens
  misc_feature (825)..(825): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagacttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429442 - DNA, 5779 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429443 - DNA, 5757 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429444 - DNA, 4732 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagttt

SEQ ID NO: 429445 - DNA, 5910 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgttaatttcacctaccagtttttgaaaaagaagttctatatatttagccaatttatgtatgatgaacacatcaaatccagattgattaaagatattcgatttttcagggaaattaaggaccaaaatgatcataagtatccttttgatagagcagaaaaattcaatcgaggcatcagaaaacttggaataacacctgagggacagagctaccttgatcaattcaggcaactcatcagccagattggacatgttggctctagggatggagcagtgaagaagacaaaggctgtactcatggatcttgaactctaggtgggggaagatgcagacagaaaaatacatagtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429446 - DNA, 3185 bp, Homo sapiens
atatttaatatagttatatataagtatgtatgtttatattttaagtgtagaaatatgtaacagttttactttttatgataagaactgaagtaaaatatagcaaaatattttggttcttaggagtggaaaccttgtaatttactactgtatgtaactatattcctattagaatttagagttatttatataaatatctgatttttttgtgtggtttttaaggtaatgctatgggctatgtacgaatgataagatctggtggtcttcattgtagcagcaatgccattagatttgttcctgatcttgaagatattgtaaattttgaagaactagtaaaagaagaaggtcttgcagaagaaacattaaaagcagcaaggcatttggattcagtcctcagtgatcacacacgaaattctgccgaaggcacagaatatttcaaaatgcttgtagacgtttttgctccagaatttcgaaggccaaagaatatacatctccgaaatttctatataattgttccccctctgaccctcaactttgtagagcattccattagttgcaaggaaaaattaaataaaaaaaataaaattggagctgcctttactgatgatggctttgccatgggtgtggcttacattctaaagcttttggatcagtatcgggagtttgattcacttcactggttccagtctgttagagagaaatacctgaaggagataagagcagttgctaagcaacagaatgtacagtcagccagtcaagatgaaaaactcttacaaaccatgaatctcactcagaagcgactggatgtctatctacaggaatttgaattgctgtatttctcactgagcagtgcaagaattttcttcagagcagacaagactgcggctgaagaaaaccaagaaaagaaagagaaggaagaagaaactaaaacaagcaatggagacctgtctgacagcactgtgtctgctgatcctgttgtgaaatgatacggatggtattcactgcacatatgatgaaatcatcagaattgttaaaacttttgccagtggaatggataaactattgatgaattgtttcctgggtcacatctctggaaaatagatgttacagttcttaaaggcagtgctttaaagtgaagttcattctgtttccaaaggctctactttcaaaggttaagaatgagattttaaaattggatttttgcctggacttgagggtacaagatgtttctatttgaagtgaagttataaaagggcaaatccagattcataaactatcacctcggatttcttgtaatctacatgtttgtaatttgtatttgcatagatctttgatctatagttatttcaagtcatgggaaattcaatgcatatactatatacagccagtaaatacatgcttaacaaaaggaatgagcctgaagttcataaagaatacatatcaatattcttataaaaggaatatatgaagatggctttgatactagaggtgaggcacaagtgttttatgtactctcagtgtacagtataactgatgatccttctttcattgttaatttcatgtgactcacaagagctgctgatgtctttgatgagacattttataactagtttacattgctttgagaacatttaacctccaacagctgctttaaatttaagatttacttaatactcagaaaattcagataaagccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagctgttagttttatttttgtaaaggtatgtaagttattaaatggttaatcatggccttttaaaaataaaataaagtgatacctttacaatgaagacaaaagtttaaaactttctaatacaaacaccattttgggaaatgcttgatttttttctattgcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429447 - DNA, 3636 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactaaatgggcattcaccgcttggcgtggtggcccacgcttgtaatcccagcactttgggaggctgaagcaggaggatcacctgaggttgggagttcaagaccagcctgaccaacatggagaaaccccatctctactaaaaatacaaaattagccaggcgtggtggcgggcgcctgtaatcccagctgcttgggaggctgaggcaggagaatcgcttgaacctgggaggcagaggttgcagtgagctgagattgcgccattgcactccagcttgggcagcaagagcgaaactccatctcaaaaaaaaaaaaacaaacaaaaacgaaatgggcattcacttgaaggaattatttgaactcgtatgctatttttctgtctgtggaaaaagagaagtctttgaatttacctggttttcagagcacagttaatttctcctttaggggagaagactgaatgcttaagtagtacagtattattaaacacatttggagtagggaattgggagaaaatggaaagttaagttgggatcatttaagtatacagtgggaaagcattgaagattttgagccaatgagtgatatgattggagctccattatagtggggttatcaatatagaaatgaaacatacaattttaaattccaaatgaagagtcatccatgtaatgatcatgtttgtacctttgaggataaataaaactgaacttttgagagtaaaaaaaaaaaaaaaaaaaaaaaaaaaaaaaaaaaaaaaaaagggggggggggaaaaaaaaatcccccgggggggccatgttttacgtgatcaccggttttttgtgaaaaggggggcccatatagggagcacgattataaaaggcaggacaggggcgcgttatacaaggcgtgagggaaagggcagattggggacttggggaaggaccctactctgtggggtgggcaattgggacactacttagaaagaataagtcatagtaatataattaggggtaagtggtcaccaccgcattgtggacgaaagtggtgggtaatatagatg

SEQ ID NO: 429448 - DNA, 1251 bp, Homo sapiens
atgccgcgcgatcccgagtagattagtgagcatggtacatactgtgatgtcctatgagagtcctgggcatgaacatattagtctagagtgtgctacatccatgtacctaacagcaccgtaggcctaaccgagactatccttgaacaaatgaccgaactaggagttcaagaagtcactaatggaaactatcatttagagataccagctctgaactcgatcttatagcatttgtctgctaaacatttctttggataaatcctgcaaatacttctaacattattctttgattccagcttttagaatgggtgtacaatgccctgtttgtacttactggttagggtcagggtaacttgccagcccaagataaatactttaatcgttaaaagtcagaagagacagaatatgtaggaaatgttttttgtttattatgtaaacatggcttacagaattatgaacagtggatagattaaaggcatttaatatttgtaattcataataactgtagaaatggccctaaagcatgctgcataattaataatttatattttcattattataagtgtttatattaatgatcttgcatttgattatatcaaattcgtcatttcatagcaacagtattgttttctctgtttttcttctctaacttctctgaaatcatctcctattaagggatagaaattgttactagaagagaatcacatgttctgtgttcattatccctacacatgtaaattaattattttatcaatactagatagagttcacatgctgactccctggatacctacagttgagaagaaaatgacagacaattatttttcctttaggtcaaaataatgtcactgctatctggataaattataagttcatatatttgaaataagatcctggaaacgaatttaaatggtgtcaaactgcagagcaacagggcttcagtatattcacatctaataggttaatatgtacatttggatgatgatttttcttgataacattaacattaattttattttttcagacatactgtaatttaaaaattaatgtgagcgtttgttttaagttcacagaaaacttaataattcaaattctcaggaattaaggactcaccataacattgtcagttctaatgaaattttgtaaaagatggcaagtttgttacctcacttgagtggggttttccttttcccccaattctaagagaatataatgtgtatactaaaacattaataaacataattttgaaaattt

SEQ ID NO: 429449 - DNA, 3024 bp, Homo sapiens
  misc_feature (965)..(965): n is a, c, g, or t
aagtcacgtgctgtgacagtagctggggtgaggccgtcgtcgccgcacgggctggttggggctgtgtctgtgggaggcgccggggtgatggcggtggagactctgtccccggactgggagtttgaccgcgttgacgacggctcgcagaaaattcatgccgaagtccaacttaagaattatgggaaatttcttgaggagtatacctctcaactgagaagaattgaggacgctctggatgactcaattggagatgtttgggatttcaatcttgatcctatagcattaaagcttttgccttatgaacagtcctctcttttggaactcataaagactgaaaacaaggtcttaaacaaagtcatcactgtttatgctgcactttgttgtgaaatcaagaaattaaaatatgaggctgaaactaaattttacaatggtctcttgttttatggagaaggagctacagatgccagcatggtggaaggtgattgccaaattcaaatggggagatttatttcattcttacaggaactgtcttgctttgttacgaggtgctatgaagtggtgatgaacgtagtccaccagttggctgccctctatatcagtaacaagattgcacccaaaattatagagacaactggagttcattttcagactatgtatgagcacttgggagaactgctaacagttttgctcaccctggatgaaattattgataatcatatcacactgaaagaccactggactatgtacaaaaggttactgaaatctgtccatcacaatccttcaaaatttggaattcaggaagaaaaattaaagccatttgaaaagttcttgctgaagctagaagggcaattactggatggaatgatattccaggcctgtatagaacaacaatttgattctctcaatggaggagtatctgtgtcaaaaaatagtacttttgctgaggaatttgcacatagtattcngtcaatttttgcaaatgtagaagccaaacttggagaaccttctgaaattgaccagagagacaagtatgttggaatttgtggactctttgtattgcactttcagatttttcgaactattgataaaaagttttataagtctttattggacatttgtaagaaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaaagatgtacagtcttactacgtctttgtgagctcatggatgatgaaaatggaatctattttgtctaaagagcagagaatggataaatttgctgaagatctcaccaatagatgtaatgtttttatacagggcttcttgtatgcatatagtattagtaccattattaaaaccacaatgaatctctacatgtccatgcaaaagccaatgaccaaaacctcagttaaggcattgtgcaggcttgttgaacttctcaaggcaatagagcatatgttctacaggagaagcatggttgtggctgattcagtttcacatataacacagcaccttcaacatcaggctcttcattctatttctgtggccaagaaaagagtgatttctgacaaaaaatacagcgaacagcgtcttgatgtgctctctgctctagttttggctgaaaacactctaaatggaccaagcacaaagcaacggcgacttattgtttctttggcactaagtgttggcacacaaatgaaaacatttaaagatgaagaactctttccacttcaagtagtcatgaaaaaactggatcttattagtgaacttagagaacgagtccaaacacaatgtgactgttgttttttatactggcatcgagctgtcttcccaatttatttagatgatgtatatgaaaatgctgttgatgcagccagattacattacatgttcagtgctttgcgcgactgtgtacctgctatgatgcatgcaaggcatttagagtcctatgagatacttctggattgctatgacaaggaaattatggaaattttaaatgagcatttgctggacaaattatgcaaagaaatagagaaagatctgcgactttctgtgcatactcatttaaagctggatgaccgaaaccctttcaaagttggcatgaaagacctggctctttttttctctctgaatccaattcggtttttcaatcgtttcattgacattcgggcttacgtaactcactacctagacaagactttctacaatctaacaactgtagcccttcatgactgggccacttatagtgagatgagaaacttagctactcagcgttatggactggttatgacagaggcacatcttcccagtcagactttggaacagggccttgatgttttagaaattatgagaaacattcatatatttgtgtcccgatacctctataatctcaacaatcagatttttattgaacgaacaagcaataacaagcatttgaatactattaatattcggcatattgctaattcaattcgaacacatggcacgggaattatgaatacaactgtaagaacttttctttgggggttgagtgggtaatagacccgtttaatagcttggaacgtggttttctcatagaatattgcggtaaacatacactactagtttatattttacatgaatttccattttttttctggttagtaattaaaatgtctggtcctaaaattgtgttggatgtgatgggagctgtgatacaaaagacactttagggtagattaccatctcagagccatcattataaatagtgctagatatttgaggacatcagcacattaatatatgtgtgtgcacacatatatatatgtttatctgtgttgatctgtgatccctgaaagtttacttttgaaagtcaacaatagatagtaatttacttaatgttatttatgccctttttggggcagggtttgctaattatttgatgtccat

SEQ ID NO: 429450 - DNA, 352 bp, Homo sapiens
gaaaaaatatttttaagaaatattcatatttttctttatggaaataagtgtgtttaaatgcacaagataggaaaggactagcgaatgtgattttttttgggtatatttagttaaagtatatgctttaggttctttttctttaggaaagttaagacagttgtggaaaatcatttttccttcagatcgaggttttgtctttcaagataattaacttttgcagtattgtttagattagagacctggtttttctaaattcatgtacattttaattttcttcttagtacatgttcagtgctttgcgcgactgtgtacctgctatgatgcatgcaaggcatttagagtcctatgagat

SEQ ID NO: 429451 - DNA, 425 bp, Homo sapiens
cattattaaaaccacaatgaatctctacatgtccatgcaaaagccaatgaccaaaacctcagttaaggcattgtgcaggcttgttgaacttctcaaggtaggttttagattattttactgctccatcataattgagaaatgacccaggcttaaattaggataatcttgtaaggtttgactacatgattatatgagaacagaaaattgtgagaaagtacttctctctcaattgaataaaggaactagccatttaaataaatttctgagtaactacttatggctggtcattatatttaaactttattaaataaagttaatatatccagtttacacagtaaaaaaaaaagttaatgtagtgagagagaaaagaaagaaaatggaaaagttaactttaatattatcagtaaagctttactcttggaagt

SEQ ID NO: 429452 - DNA, 558 bp, Homo sapiens
aatcagccaccttatgctccataggacaagtagagtcgtgattgtgtcatgttgggccatttctttccttacgtgttgtctaatgagattgttttggatgaagtagttgatatggtgctaatgttgagtacaggatctaacacaagtttaagtcgaataaagctagcctcaatttgtgtttttaaaatttcagttatttttcaaattaaaagaaatgttcttttcctttgtttctgtagcttttgccttatgaacagtcctctcttttggaactcataaagactgaaaacaaggtacagaatcctaaatctaaaaaattgttttaaaaatgttttagttatctgtaacaatttactttttattttgtttttactcatgaaactaggtcttaaacaaagtcatcactgtttatgctgcactttgttgtgaaatcaagaaattaaaatatgaggtaattatttgaattcttgtcttaaaactttaaaaacatcatttagaagcaagtatgtgtttatatatgtacagtgtgcaataaatatttattgaatgttgaatgaa

SEQ ID NO: 429453 - DNA, 636 bp, Homo sapiens
cagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttctttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccac

SEQ ID NO: 429454 - DNA, 690 bp, Homo sapiens
cagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttcctggccagccccttctgcctttcacacgggctcccacaaactgtcctaagtgtttttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccac

SEQ ID NO: 429455 - DNA, 5223 bp, Homo sapiens
  misc_feature (2)..(3): n is a, c, g, or t
  misc_feature (5028)..(5028): n is a, c, g, or t
cnnaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcacctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatgtgtgggttttctgtttattatgccaaggccaagaggagcctgtcctgccctacacgttcccctcgttcgtcccatccggccgctcagcaatggagctaagaggagtggtgatgggcaacagaaatgaggtgctcctcggagcgggactgacgacacatgaggactgtgaggggaggaggcggagccggtgcctcgggttcagggagtgaggcctcctagtgaaaggctgggcccttgccctagagtggaggctagggaggaacgggagctgtagacggatgtggcttcccagacacgctgctcttccagaagggacagtgatgccacctggtggccgaggccatggacgtctctcttcccaaatggacctgactcttcttgactgccttgttctcttagaagaagccatggaactgtccactgcctgagtagtccctggcttttagaggcacacacacaaaaagaggtcagtaaactgttctaggggtcttcaagtttacgacactgctcacggcccaccttccaacacatagccacaactttgaccccgttcccatctcattccaggggcccagagcagcattaatgcaatagtggatgtgcactgcctgtacacggtggggggcggggggaccttttgcggctgatggtaacaagatggagggtgagaacgctggggcggcgtcatgagccgtgtgcagccagagaggcagcttgcgttttctggaccagaagcagggagggtgtggagaaggccaaaaacctcagggcgacctaagagctgtcctgcagcggggacagtggggacagcagggacagcggggaggcaggaaaagccccgaacacagctgaggcaggttctcagagcaagcctcagggccactaccaggtgacccctgccctcagctctcaccagcgaccctcacagaaacacaaaagggaggggcgccgacctcaacaatggcccagaggggccatactgcctggcaggggttctcaacctttagggagcgggagcaaggggccttccgaggataaatagaaatgaggaaaatgaggggaggtgacctctcatccttcctcttagctggagttatggaccccctcgcccctccaagttctacccaggctttggtgtgtccattactttttcagaggtgaagatccacagtttacatcaaattctcaaagatgctcccagaatggtagaaaccaggctgtgcataaaaattaacctgcctggccgggcgcaatggctcatgcctataatcccagcactttgagaggccaaggcaggcaggtggatcacctgaggtcaggagttcaagatcagcctggccaacatggcaaaaccccatctgtactaaaaatacaagaaaaacttagccgggcatcgtggtgcgtgcctgtaatcccaactacctggaaggctgaggcagaagaatcgcttgaactggggaggagaaggttgcagtgagccgagatcatgccactgcactccagcctggacaacagagcaagactccttctcaaaaaaactctggctgggtgtgtgtgggtggggactagggggatgcctgaatgagaatccctgaatccttgagtgtgggggttcaggaatatgtatctaacaagctccttggattagtcaagtttgtgtgngggctcaggaatatatgtatctagcaagctcctcagactagtcaactttcttaatagtctgcatatttgtatattgcccagaaagggacactttttggaatatactttcttttttttaacttatttcgcattatattgtttacttaataactccaagcaaataaatgtacatctttatcaacattcccaatgact

SEQ ID NO: 429456 - DNA, 690 bp, Homo sapiens
  misc_feature (21)..(21): n is a, c, g, or t
  misc_feature (42)..(42): n is a, c, g, or t
  misc_feature (51)..(51): n is a, c, g, or t
  misc_feature (615)..(615): n is a, c, g, or t
  misc_feature (632)..(632): n is a, c, g, or t
  misc_feature (660)..(660): n is a, c, g, or t
  misc_feature (663)..(663): n is a, c, g, or t
tttaatacctttcgactaccnctactatgctgcgagaagacnacagaaggncggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcacacctacatcccggtgctgccacccgccatggtcgacatcgtgtgctcgccgacgcccttcctcatcgggctgctctccagctcgctgccactgctcagggagctgccgctggaagagtccttgtgggttgaccctcgttaaacagccggtttccttagacaggatggaccnattaaggacttccattncttgccccccggaaaagctttaaggttnggncccttggaaacaacaattttttgggaa

SEQ ID NO: 429457 - DNA, 3366 bp, Homo sapiens
  misc_feature (2)..(3): n is a, c, g, or t
cnnaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcacctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatg

SEQ ID NO: 429458 - DNA, 1017 bp, Homo sapiens
ctctccctgttctctccccggctgcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatg

SEQ ID NO: 429459 - DNA, 1373 bp, Homo sapiens
  misc_feature (21)..(21): n is a, c, g, or t
  misc_feature (42)..(42): n is a, c, g, or t
  misc_feature (51)..(51): n is a, c, g, or t
tttaatacctttcgactaccnctactatgctgcgagaagacnacagaaggncggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatg

SEQ ID NO: 429460 - DNA, 2740 bp, Homo sapiens
  misc_feature (2)..(3): n is a, c, g, or t
cnnaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcacctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcaggtacccgccttggctacttctgctaaagcgtttgaatgacagtcgctcttggaccctctagtctgtagagcaggtgaccgcctagcattgaagagtaagcccttctgagataaggatggaataggctgggcgcggtgactcacacctgtaatctcagcactttgagaggctgaggtgggtggatcacttgagaccaggagttcgaggccagcctgtgcaacatggtgaaactccgtctctactaaaaatagaaaaattagccagccatggtggcccacgcttgttatcccagctacttgggaggctgaggcacgggaatcgattgaacctgggaggtggacattgcagtgagctgagatctcac

SEQ ID NO: 429461 - DNA, 396 bp, Homo sapiens
cactccagcctgggtgacagagcaagactccatctcaaaaaaaaaaagaggcaactcaacatcccctctgaattagaacatttgatctgtgctaccacatagaaagagtttcctacatgagaagaactcacatttgcaattttcttccttgttcttttcttctagtgacagatgagaacagtgagtctgacagtgacacagaggagaagctgaaaggtgaggagagccactactgtgcaggactcaggcaggtgacttggaagctgcaaaggtggcccctcctccttagtatgagggacagaagcgtcctgccggagcttgcttggcaaggcgtggacatctcgggagacagtggggccacagggtgctccagagccggtccgtcatgggcatgat

SEQ ID NO: 429462 - DNA, 303 bp, Homo sapiens
gttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacaggtaggtgccggtgtggccaggcagagtgtcgccacctgactctctcagtggtttgtgtcccatcataaccgtct

SEQ ID NO: 429463 - DNA, 196 bp, Homo sapiens
gttggctgtaattaaatgaatgttggagttaatgctgtttccaacctatgatgggtttttcaggactgacaccatcataagttgaggagcatctgtattttgtcattcaactcctgagccaagacatcaagattagtgtttgcatgagtagcaaatattcccaaggaagagacagcacagcaccacaccatggttc

SEQ ID NO: 429464 - DNA, 1845 bp, Homo sapiens
gggcgacactggcttcccttttgggatttcccagaagatccagattttcttaagtccccttggaacagactaagaaaggatcaccttagaaatcacctggtcctattgtcccccccgtacatgagtaactgaggcccacagagagcaaatcgcctgcctgagtcacacagcagtgagtggcagacctaggctaggaactaggactggggattgctattccagtgctccccatcctcacacagactgcacagtccgcctggacacaccccagctgacagtggtacctcccagtcagccaggagaatggattccttctcctgcagtaggggccccctggctgagtggcctgattgactaaaacatatgtctttgaaggagagtgcatcacaagcacctttctttggggtagatttttctctgggtctagagggacagctcaggcttgggactgggcctcagaacctacgacagaccgtgagagcagacccaccttatccatctggtgccagctccccaggtcagctacagcgacccccggacttcatagagtacaatccacagtaatagcacacagctctgtacctatctagctccatgcctatctatctgcctacctttcacaaaataattcttagcaaccctgctacagccaatgattctaatacgttctgttctattgcatgttataaaatgctggtcacgatccactaaattgatgtctctacctgctaatggtttaatacctgcagattgaaatatactggagaaataaagagagtgggagtagggacactttctcccagtgcccacaccgcccctcgttacccgcataggtcaactgaaagatacagagagggaagctttgatggggggttcagagttcaaaggaagaaatgatggcacctgcactccctgcccccagaggcaggacacagccagccctcctgtgacagcactcctggcagctccttgttggcctgcagccctcagggggcttagttgccattgactcacccactcctaaggccaccacatcaaaatctgaggcttactgccctgtcccacctgcctctgtctttcttaaaacagctaaatgcaacaatagcagaaattagcttgtttttgaggttggcaatgaccagttcaaggtgactcttattttcttaagcagtgcttgcaggacataaatgtgatgacacttgccctcctttctttatcgcctgggacagactttacaaacagacctgggagaagtcccctaaggggctgcatttatccccatctccctaggggtgatcagcattgtgacagctgggcagagcagtggtgaactgcacccatgtccctgctcacatctcctaagatctcagaattgcctgaggttctagcgtgggctccttctctccagatgatgccatccccacccccctcatttccacacagcatctgaggcatcctgcactaaaagatatatgtacagcaaaacaaaaatagaaaaccagcacagcagagtggaggtggggtataaatatacccagatccccgctgatttggttactcggggtgagcatcagatggaaatagaagtttccgggggccaagagagaaagagggatgtaacgacaattcttttcaaaacgtgtcccatggtatgcctcgtggaaaaaatggttcattggtcaaatgaatttgggaaaatgctgtcaatatcaccgactcatggagcttcgcaaggcatcttagcttaataaaggttatgaaaagtcttgcagcaaagatgctgtttacccctgcttaatccagcactgcccaaactcattccaaataccagagcctctgtttgca

SEQ ID NO: 429465 - DNA, 419 bp, Homo sapiens
acagatcgaaacacaaaaaatacaaagagatcttggggagggcaagtcatttccagaaaaggacatccccacccccctcatttccacacagcatctgaggcatcctgcactaaaagatatatgtacagcaaaacaaaaatagaaaaccagcacagcagagtggaggtggggtataaatatacccagatccccgctgatttggttactcggggtgagcatcagatggaaatagaagtttccgggggccaagagagaaagagggatgtaacgacaattcttttcaaaacgtgtcccatggtatgcctcgtggaaaaaatggttcattggtcaaatgaatttgggaaaatgctgtcaatatcaccgactcatggagcttcgcaaggcatcttagcttaataaaggttatgaaaagtcttgca

SEQ ID NO: 429466 - DNA, 1771 bp, Homo sapiens
gggcgacactggcttcccttttgggatttcccagaagatccagattttcttaagtccccttggaacagactaagaaaggatcaccttagaaatcacctggtcctattgtcccccccgtacatgagtaactgaggcccacagagagcaaatcgcctgcctgagtcacacagcagtgagtggcagacctaggctaggaactaggactggggattgctattccagtgctccccatcctcacacagactgcacagtccgcctggacacaccccagctgacagtggtacctcccagtcagccaggagaatggattccttctcctgcagtaggggccccctggctgagtggcctgattgactaaaacatatgtctttgaaggagagtgcatcacaagcacctttctttggggtagatttttctctgggtctagagggacagctcaggcttgggactgggcctcagaacctacgacagaccgtgagagcagacccaccttatccatctggtgccagctccccaggtcagctacagcgacccccggacttcatagagtacaatccacagtaatagcacacagctctgtacctatctagctccatgcctatctatctgcctacctttcacaaaataattcttagcaaccctgctacagccaatgattctaatacgttctgttctattgcatgttataaaatgctggtcacgatccactaaattgatgtctctacctgctaatggtttaatacctgcagattgaaatatactggagaaataaagagagtgggagtagggacactttctcccagtgcccacaccgcccctcgttacccgcataggtcaactgaaagatacagagagggaagctttgatggggggttcagagttcaaaggaagaaatgatggcacctgcactccctgcccccagaggcaggacacagccagccctcctgtgacagcactcctggcagctccttgttggcctgcagccctcagggggcttagttgccattgactcacccactcctaaggccaccacatcaaaatctgaggcttactgccctgtcccacctgcctctgtctttcttaaaacagctaaatgcaacaatagcagaaattagcttgtttttgaggttggcaatgaccagttcaaggtgactcttattttcttaagcagtgcttgcaggacataaatgtgatgacacttgccctcctttctttatcgcctgggacagactttacaaacagacctgggagaagtcccctaaggggctgcatttatccccatctccctaggggtgatcagcattgtgacagctgggcagagcagtggtgaactgcacccatgtccctgctcacatctcctaagatctcagaattgcctgaggttctagcgtgggctccttctctccagatgatgccatccccacccccctcatttccacacagcatctgaggcatcctgcactaaaagatatatgtacagcaaaacaaaaatagaaaaccagcacagcagagtggaggtggggtataaatatacccagatccccgctgatttggttactcggggtgagcatcagatggaaatagaagtttccgggggccaagagagaaagagggatgtaacgacaattcttttcaaaacgtgtcccatggtatgcctcgtggaaaaaatggttcattggtcaaatgaatttgggaaaatgctgtcaatatcaccgactcatggagcttcgcaaggcatcttagcttaataaaggttatgaaaagtcttgca

SEQ ID NO: 429467 - DNA, 4009 bp, Homo sapiens
  misc_feature (1610)..(1610): n is a, c, g, or t
ctgggtctccagcacaccctggagaaaagcaggtcagggggtggtgcttctgtttccagatgagcaaactagggctgagggagagggcgttctctggtcagggtggtagagccagtctcgtggaagccggctgagccactgaaacagaatcagttttctcatggaccaaacggggatagtgtctggcctgcgccaccccaagtgtattgtgaagatgaaatgagaaggggttttttgttgtggttgctggaaggagatcctagaagggaggaatgggggagaagatggcaaagggatcctaggacgaggcgtatgggcaagggaagcttgtctttctgggaggaaaatctcgaaccaagaatttcaggaagaaggcactgggaaaagagggaggaggtgccctcagatccatggaggtgagtgtcagcccccagatctcttgtgtggccaccactttcacggcaaccactcctcactgggaatccttggagtctggtgctttcaccaccctgccccggctgcttcatgtgtgccacctcgccctgtttccagactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggtaagcagtcactcccagcctcccttggggccagcagaaatgtcactaaggtaggggnccatcttctgacccaggtggtgctttgtggcttttggcaccagctctgagcaagggctcggcactcaccaaggagtggccatggctttgccatgccttcagctcagtctctggcactgaccaaccagaaaggtgtctgcacttggttcgagcatccttccctgtgagcttggggatgcttcagttcttgccctccacacagctatgggtagattccaggaggccagctgcagctcagggacagattatgactgagttttcaaaccaaaaagtcagtcagtgactccacaggacttctaccattaaaactaaagaaacagactcacataggtggtttgaattgcccaaagttgcccacccaactactggcaaaattctcagcaagttgtgaatgaggaatccatgctatgatgcggtttctccctgatggctagtcaaaaaagtatcattaatcatttactcatttactcatttgtacactaaagaacatgcctagggctgcctttgcttttggcaaattctgctccttattcctatcctccttacctgctggagatatttggaggtcccacaacaatggctaaccaataaatccatgcaagcatctgaacctccactcccttgttgctgtgagagacatcacttataggcactcgctgttgtgccacagtctcaaaatctctgaataggcactctaagcagtgatgaacacacagggtttgaaacatttatcacctctgtgcctaaaatagtttttctcacattttttctatgtatatcaaggttgctacagtggataactaactatctttttggtggggggtgggtgctggtatttgaatggtaccctaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcattttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttaggttttttaaaataaaatgttcattgtatttgaagttttcctcagttcatgaaatgacttggggcagggcctggggggttctcaagggaggaaatgttttggttatttacacactgaactacaagatgggatcctagcaggaaactcagcctccttgaatcaaagagcatagataaggctgaaagcaaattttagttgtacagttaacaacataccaaagacacaggaaacatctgcagaaattgatcatatataagtgaatgaaaaatcagtactcctcccagaagttaaatatactcctaaagaattcttgggaaaaaagaaacataccaatactggg

SEQ ID NO: 429468 - DNA, 3534 bp, Homo sapiens
cggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacaccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtagga

SEQ ID NO: 429469 - DNA, 3109 bp, Homo sapiens
tgcgtcccctcctgcagcccggtcccctcctgcatctgcgtcccctcctggagcccagtcccctcttgcatccgcatccgcttcccctcccgcagccccgccccctcctgcatctgtgtgccctcccgaagccccgccccctcctgcatctgcgtcccctcctgcagccctgtcccctcctgcatctgcacttcctcctgcaggttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcattttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttaggttttttaaaataaaatgttcattgtatttgaagttttcctcagttcatgaaatgacttggggcagggcctggggggttctcaagggaggaaatgttttggttatttacacactgaactacaagatgggatcctagcaggaaactcagcctccttgaatcaaagagcatagataaggctgaaagcaaattttagttgtacagttaacaacataccaaagacacaggaaacatctgcagaaattgatcatatataagtgaatgaaaaatcagtactcctcccagaagttaaatatactcctaaagaattcttgggaaaaaagaaacataccaatactggg

SEQ ID NO: 429470 - DNA, 1905 bp, Homo sapiens
  misc_feature (1840)..(1840): n is a, c, g, or t
  misc_feature (1885)..(1885): n is a, c, g, or t
ggagccgctagtacgcgttccgcgtgccctattacggatcgattgcctggagcagttgctgactgagttggatgacttcctctgtattcttggacattgagaacctgagcagcacagcgatttggatgaagaagactgactggcgccagctctgtcctgcttgaacagcaatcagcatacacgctctgcatcgatgaggtacgtctgtattgagcactgtgaccagtctaccaagcgatggtattgctgagtcatcaaggaccaagcgcattaggtagcagggtcgtgctacccaaggtgggggagcccatgacacgtgactcttcggcccctcagactaggcttcctgactctcctcgccaaccgaggatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacaccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggccccagcagtgcacaggcccaggcctcctccccgacgttgtcctgcctggacaatgcaactgaggccctcccggcagactcaggcccaggtcccaccccagatgagccctgtatgacgacgtggacctgtcagagctcacagctgcggtgggagcctaccgagggaagccacccctgttgcagatgacccaaatgagagagaatttgaccgagtgttacctggggaccttcacacctgttcaagttccttttcttgcatgggccccagcagttgccggggcggagggagaggcagggcgcttgggacntggggagtttcagcattcatggggaggtttgaagggacaactttnaaggaaggttttagggcagg

SEQ ID NO: 429471 - DNA, 592 bp, Homo sapiens
ggtacggtcatggcctggtggggaggggctggcaccaggcagcactgcctggccctgcttatgtctctcttggcctcgttccaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttgtgagtaatttggacccttcctccgtacactctcttattcctggccatgctgtaggccctgggtcagccagagtcaggggcagcagggagcacagggtcccaccccactctgcccagcagcaggaaaatgtgaagccaaggagtagccctcagggaggcccggccaagagccaggagctgagctaagagcaaggagccgagccaggcttcgggccccgggggcagctttggcatcctcagaggcagttagactctccagctcctccaggcagagctgtcacctttcctgacctcctacttgtccttctggtgaatccctcactgggtctccagcacaccctggagaaaagcaggtcaggggg

SEQ ID NO: 429472 - DNA, 4260 bp, Homo sapiens
cggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacaccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcattttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttaggttttttaaaataaaatgttcattgtatttgaagttttcctcagttcatgaaatgacttggggcagggcctggggggttctcaagggaggaaatgttttggttatttacacactgaactacaagatgggatcctagcaggaaactcagcctccttgaatcaaagagcatagataaggctgaaagcaaattttagttgtacagttaacaacataccaaagacacaggaaacatctgcagaaattgatcatatataagtgaatgaaaaatcagtactcctcccagaagttaaatatactcctaaagaattcttgggaaaaaagaaacataccaatactggg

SEQ ID NO: 429473 - DNA, 4035 bp, Homo sapiens
ggagccgctagtacgcgttccgcgtgccctattacggatcgattgcctggagcagttgctgactgagttggatgacttcctctgtattcttggacattgagaacctgagcagcacagcgatttggatgaagaagactgactggcgccagctctgtcctgcttgaacagcaatcagcatacacgctctgcatcgatgaggtacgtctgtattgagcactgtgaccagtctaccaagcgatggtattgctgagtcatcaaggaccaagcgcattaggtagcagggtcgtgctacccaaggtgggggagcccatgacacgtgactcttcggcccctcagactaggcttcctgactctcctcgccaaccgaggatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacaccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacgtgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattactctgtgtttacagattcattgctgtggtcaggccatttttaagggaagagttatttaatataaatagtctctgattttaagttctgtttaatgttcattctccttccaagaacaaagtggtgatttttggttagggtgatcgccctcttaaaattggcagtgctgttccttgtgctgcccctgtcttttcctctgatggcattttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttaggttttttaaaataaaatgttcattgtatttgaagttttcctcagttcatgaaatgacttggggcagggcctggggggttctcaagggaggaaatgttttggttatttacacactgaactacaagatgggatcctagcaggaaactcagcctccttgaatcaaagagcatagataaggctgaaagcaaattttagttgtacagttaacaacataccaaagacacaggaaacatctgcagaaattgatcatatataagtgaatgaaaaatcagtactcctcccagaagttaaatatactcctaaagaattcttgggaaaaaagaaacataccaatactggg

SEQ ID NO: 429474 - DNA, 3200 bp, Homo sapiens
cggcgagcggggccgcgggcgcgcaccgactcaagagccgactgtcagcctcggcgggccggagttctccggcgctgggacaggggcgctgggacaggggcgctgggggcgagccctggcgggggccaggtccgaggaccctgggcgcggcggccccgccaggaggtccggccgcgagcgtgacctcacggggaggggccagcgcggcggcctgggcgctgagccgagcgccgggagagcagcgcagaagccgagccgcgaggagcgcactccgtggccccgatggagcggtacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacaccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttaggttttttaaaataaaatgttcattgtatttgaagttttcctcagttcatgaaatgacttggggcagggcctggggggttctcaagggaggaaatgttttggttatttacacactgaactacaagatgggatcctagcaggaaactcagcctccttgaatcaaagagcatagataaggctgaaagcaaattttagttgtacagttaacaacataccaaagacacaggaaacatctgcagaaattgatcatatataagtgaatgaaaaatcagtactcctcccagaagttaaatatactcctaaagaattcttgggaaaaaagaaacataccaatactggg

SEQ ID NO: 429475 - DNA, 407 bp, Homo sapiens
tgggcaccagaactgtgaggcagggctggtaccccctccacagctgagggagtagaggtaatgttgaatgccccagactcactctctcctgcaggtggagcctaccgaggaagccacccctgttgcagatgacccaaatgagagagaatctgaccgggtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacaggtacaggcctcccctgcaggacagcaagaccaccttcctgcgccccttcagccagctgagtcaggtc

SEQ ID NO: 429476 - DNA, 378 bp, Homo sapiens
tcccacctcggccccccacgcagctgggactacaggtacatgccaccacacccagctaatttttaagttttttgtagagacgaggtctagctgtgttgcccaggctggctcctgggctcaagggatccctctgcctcagcctcctaaagtgctggggttacaagtgtgagtcacctcgcccagcctcttgcttttcttataaggacactagtcctattggatgcaggcgccactccaacgacctcatttagcctatttacctccccaaaggccttgtctccacatatcatcagattgtgggttaaggcttcaacatatgacatttaattcagctcgtaccagagggtgtttaagcattttcccattgaaatgtattcc

SEQ ID NO: 429477 - DNA, 2604 bp, Homo sapiens
aattttatgtctggtaatggacttgtatatgtaaagaactcttataattgaataataaaagggcaaatagcccaactgaagagggcaaaggatctgaataggcatttctgcaaaacacatgaaaagaagctcaacatcattagccatcagggaaatgatttcacttaatgcccacaaggatggctataatcagaacgagaagacagtaacaagtgttcacaaggatatggagaaatgggaacgttggaactgtcatatgttgctgtgagaatgtaaaatggtgcagccgttttggaaaatagcctggcatttcttcaaggttaaatgtagaattaacacgtgactcagcagttccatttctgggtttatacccaagagaaatgaaaatatatgtccacagaaaaacttgtacatggatgttcatagcagcagcatccataatagcctcaagtagaagcaactcaaatgtctgtcaactgatgaacagatgacaaaacatggtacaatggaatattactcagcaatgaaaaggaatgctttatatgttacaacatgattggaccctaaaaacatgccaaaaggctgtgtattatatgactccattgataggaaaggaatggtttacatgttacaacatgattgaaccttaaaaacatgccacaaactgtgtatgactccattgatatgagaggaatggtttacatgttacaacatgattgaaccctaaaaacatgtattatatgactccatttatatgaaatgtctcaaagaggcagattcatagaaagactagtggttgccaaggtcttcattttttaggggtgcactaatggatgtaggatttctttttagagtgattaaaatgttacaaaattgctggctgggtgcagtggcttatgcccataatcacagcacttcgggaggctgaagtgggaagatccaggagttgaagaccagcctgggcaacatagtgagaaaatgtctccctaaaaggaagaattaacctcatgtggtggtgtgcacctgtagttctagctactagggaggctgaggaggaaggattgcttatcccgggaattcaaggttgcagtgagctatgattgcacccactgtacctcatcctgagagagagagcaagaccctgtctctaaaagaaaaataaatgttctgaaattgattatgttgacggtcacataactgaatatattaaaaacttaaattgtatactttaagttggtgattgtatgatatatgagttttatcaatacagctacttaaaaacctatagttatgcaaattaaaaatttcatttactggggataattgaaatgattataccgaacataatacatgtagaaacagtatagtttttgtattgctggatagtctgtttttttctttttcaatatttgaaactaaaggtcatgtaattgatgtttttcttacataactgtgaaatatttattctctgttgaaatgttttatcttacgttttctcctttaggaatgttacgttcataacttactaaggattagtgtatattttccaaccttgaggcatgaaattctggagcttattattgaaaaactactcaagctggatgtgaatgcatcccggcagggtattgaagatgctgaagaaacagcaaatcaaacttgtggtgggacagattccacggaaggattgtttaatatgggattcgcagaggcatttttggaacatctttggaaaaacttgcaggatccaagtaatcctgccatcatcaggcaggctgctggaaattatattggaagctttttggcaagagctaaatttatttctcttattactgtaaaaccatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcctcagagtctgaattttgagcggatagtgatgagccagctaaatcccctgaagatttgcctgccctcagtggttaacttttttgctgcaatcacaaagatgaagacttgtggatatggatggtggtgatggttgcacaacaatatcaatttattttataccactgaaccgtgcacttcaaaatggttaagatggtaagttttatgttgtgtattttaccataataaaaaaaattgtagagggaaaaacagtctgcctccacttttgatatgggactgctaacatcttccaccctccctctccccctctgccccacatctgggcaagctaagaaagcctgctgctctctcctctggcaccagctggaaattcatacccaacaagccctagccctcccaccagacccacatttcatccccatccccatcgcatccccatccccatccccatccctaaccaccataaatgctaagggagtttccttgcctggttttctgaaaccatttttggacctgcttgggaatctgccctgctctctcagaaagcttcattatatgagcaataaaccttttcctaccctc

SEQ ID NO: 429478 - DNA, 2322 bp, Homo sapiens
aattttatgtctggtaatggacttgtatatgtaaagaactcttataattgaataataaaagggcaaatagcccaactgaagagggcaaaggatctgaataggcatttctgcaaaacacatgaaaagaagctcaacatcattagccatcagggaaatgatttcacttaatgcccacaaggatggctataatcagaacgagaagacagtaacaagtgttcacaaggatatggagaaatgggaacgttggaactgtcatatgttgctgtgagaatgtaaaatggtgcagccgttttggaaaatagcctggcatttcttcaaggttaaatgtagaattaacacgtgactcagcagttccatttctgggtttatacccaagagaaatgaaaatatatgtccacagaaaaacttgtacatggatgttcatagcagcagcatccataatagcctcaagtagaagcaactcaaatgtctgtcaactgatgaacagatgacaaaacatggtacaatggaatattactcagcaatgaaaaggaatgctttatatgttacaacatgattggaccctaaaaacatgccaaaaggctgtgtattatatgactccattgataggaaaggaatggtttacatgttacaacatgattgaaccttaaaaacatgccacaaactgtgtatgactccattgatatgagaggaatggtttacatgttacaacatgattgaaccctaaaaacatgtattatatgactccatttatatgaaatgtctcaaagaggcagattcatagaaagactagtggttgccaaggtcttcattttttaggggtgcactaatggatgtaggatttctttttagagtgattaaaatgttacaaaattgctggctgggtgcagtggcttatgcccataatcacagcacttcgggaggctgaagtgggaagatccaggagttgaagaccagcctgggcaacatagtgagaaaatgtctccctaaaaggaagaattaacctcatgtggtggtgtgcacctgtagttctagctactagggaggctgaggaggaaggattgcttatcccgggaattcaaggttgcagtgagctatgattgcacccactgtacctcatcctgagagagagagcaagaccctgtctctaaaagaaaaataaatgttctgaaattgattatgttgacggtcacataactgaatatattaaaaacttaaattgtatactttaagttggtgattgtatgatatatgagttttatcaatacagctacttaaaaacctatagttatgcaaattaaaaatttcatttactggggataattgaaatgattataccgaacataatacatgtagaaacagtatagtttttgtattgctggatagtctgtttttttctttttcaatatttgaaactaaaggtcatgtaattgatgtttttcttacataactgtgaaatatttattctctgttgaaatgttttatcttacgttttctcctttaggaatgttacgttcataacttactaaggattagtgtatattttccaaccttgaggcatgaaattctggagcttattattgaaaaactactcaagctggatgtgaatgcatcccggcagggtattgaagatgctgaagaaacagcaaatcaaacttgtggtgggacagattccacggaaggattgtttaatatgggattcgcagaggcatttttggaacatctttggaaaaacttgcaggatccaagtaatcctgccatcatcaggcaggctgctggaaattatattggaagctttttggcaagagctaaatttatttctcttatgtaagtagcctaatttgccgagtactttttaatatcatgctttaaaaagagtatagcattgtctcaagtcagaaatatctcccatatgtttttggcatgtttttaaagtgaataaaattcctactctgtgcaagatgtttatatttctaagtggtgattttagaataaagtgtctccttttttatatataaaaaaaaaaaaaaaaaaaaaaaaaaaaatttgtggggggttggagccttggaaaaacgtttctataaaaccaatctggtgggggggcggggggcccccaaaagaggtaaagtcgcaacagcgggcgccaaaagatcgggtaccccgaggagaaaccctgggacatagacataggtggggggatttctcagccatataaaaaaagccccggggcaaacaccagcggtcttgaaaaaaaccaaagggagatcagagaacacaggggtaataacgggggcaacgaggcggaaaaaatacccggcgggc

SEQ ID NO: 429479 - DNA, 1233 bp, Homo sapiens
gtctcgagctcctgaccttgggtgatccacccgcctcggcctcccaaagtgctgggattacatttacaggcgtgagccactgtgcctggccctgggttgattttgatgcttagctaggtttgggatccattggattatttaacacccgaggtgccttttgtttctaatgatattctctcaacgtgttttaaaaatgaagcccatgagatagttatgagatagtagaacttttccctacattggtgaagtaaaaatcttgggattttgatagtcagattatcttaggcattaaaaaatatcacaccgatgccctctctttttatagggattcgcagaggcatttttggaacatctttggaaaaacttgcaggatccaagtaatcctgccatcatcaggcaggctgctggaaattatattggaagctttttggcaagagctaaatttatttctcttattactgtaaaaccatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcctcagagtctgaattttgagcggatagtgatgagccagctaaatcccctgaagatttgcctgccctcagtggttaacttttttgctgcaatcacaaagatgaagacttgtggatatggatggtggtgatggttgcacaacaatatcaatttattttataccactgaaccgtgcacttcaaaatggttaagatggtaagttttatgttgtgtattttaccataataaaaaaaattgtagagggaaaaacagtctgcctccacttttgatatgggactgctaacatcttccaccctccctctccccctctgccccacatctgggcaagctaagaaagcctgctgctctctcctctggcaccagctggaaattcatacccaacaagccctagccctcccaccagacccacatttcatccccatccccatcgcatccccatccccatccccatccctaaccaccataaatgctaagggagtttccttgcctggttttctgaaaccatttttggacctgcttgggaatctgccctgctctctcagaaagcttcattatatgagcaataaaccttttcctaccctc

SEQ ID NO: 429480 - DNA, 1172 bp, Homo sapiens
gtctcgagctcctgaccttgggtgatccacccgcctcggcctcccaaagtgctgggattacatttacaggcgtgagccactgtgcctggccctgggttgattttgatgcttagctaggtttgggatccattggattatttaacacccgaggtgccttttgtttctaatgatattctctcaacgtgttttaaaaatgaagcccatgagatagttatgagatagtagaacttttccctacattggtgaagtaaaaatcttgggattttgatagtcagattatcttaggcattaaaaaatatcacaccgatgccctctctttttatagggattcgcagaggcatttttggaacatctttggaaaaacttgcaggatccaagtaatcctgccatcatcaggcaggctgctggaaattatattggaagctttttggcaagagctaaatttatttctcttatgattcgggaacaaaggcattctgcgatgttgctctccatggaccattttactcagcctgccaagctgtgttctacacctttgtttttagacacaagcagcttttgagcggaaacctgaaagaaggtttgcagtatcctcagagtctgaattttgagcggatagtgatgagccagctaaatcccctgaagatttgcctgccctcagtggttaacttttttgctgcaatcacaaagatgaagacttgtggatatggatggtggtgatggttgcacaacaatatcaatttattttataccactgaaccgtgcacttcaaaatggttaagatggtaagttttatgttgtgtattttaccataataaaaaaaattgtagagggaaaaacagtctgcctccacttttgatatgggactgctaacatcttccaccctccctctccccctctgccccacatctgggcaagctaagaaagcctgctgctctctcctctggcaccagctggaaattcatacccaacaagccctagccctcccaccagacccacatttcatccccatccccatcgcatccccatccccatccccatccctaaccaccataaatgctaagggagtttccttgcctggttttctgaaaccatttttggacctgcttgggaatctgccctgctctctcagaaagcttcattatatgagcaataaaccttttcctaccctc

SEQ ID NO: 429481 - DNA, 534 bp, Homo sapiens
gcaatagtgctttggctgggttagagtcccagaatgtgaactttatgagagcagcaattttgacgtgcagttttctgctatatccccagcacctggaacagtgcttggcaagtgaaaggtgttccataaatattcagtgcatgaataaagttttctcttggtggggttgatttctgagttggttccatcatgggttggttatctttatcttccactctagactgtcttccttcctgtccactcatctgataatctacatgccccattcatcactagggaacccgtcacaggaagggagtgggtgaactagcataagtggaatagctaaattgaaaagactccaaaacttatgccttgctgcatacaaattgttagcaatatccttttgcttattagaatattctgaattaatatatagatgttctaacacaaattcatctctttagcactttgctatctctacaatagagagggaagaagcattgttctatttctcactgaaaaaagagtattacagaaatgattttagaagtt

SEQ ID NO: 429482 - DNA, 3529 bp, Homo sapiens
cggggaccgcagcgggctgaactgctggtgtcagagcccggcgagcgctggcagttccgcggcggggatgctgaggagcgctgggtccgggagcagccctggcccctgcggacttccgaggccgtgaaaacccctgcgctgcggcccttcccaggcccccgaggccgttcgccgttcccgaagcccgactgggggaagagtccagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcaccatgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctgggggctttgagtctgcccgcgacgtggaggcgctgatggagcgcatgcagcagctgcaggagagcctgctgcgggatgaggggacgtcccaggaggagatggagagccgctttgagctggagaagtcagagagcctgctggtgaccccctcagctgacatcctggagccctctccacacccagacatgctgtgctttgtggaagaccctactttcggatatgaggacttcactcggagaggggctcaggcaccccctaccttccgggcccaggattatacctgggaagaccatggctactcgctgatccagcggctttaccctgagggtgggcagctgctggatgagaagttccaggcagcctatagcctcacctacaataccatcgccatgcacagtggtgtggacacctccgtgctccgcagggccatctggaactatatccactgcgtctttggcatcagatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429483 - DNA, 3496 bp, Homo sapiens
cggggaccgcagcgggctgaactgctggtgtcagagcccggcgagcgctggcagttccgcggcggggatgctgaggagcgctgggtccgggagcagccctggcccctgcggacttccgaggccgtgaaaacccctgcgctgcggcccttcccaggcccccgaggccgttcgccgttcccgaagcccgactgggggaagagtccagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcaccatgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctgggggctttgagtctgcccgcgacgtggaggcgctgatggagcgcatgcagcagctgcaggaggagatggagagccgctttgagctggagaagtcagagagcctgctggtgaccccctcagctgacatcctggagccctctccacacccagacatgctgtgctttgtggaagaccctactttcggatatgaggacttcactcggagaggggctcaggcaccccctaccttccgggcccaggattatacctgggaagaccatggctactcgctgatccagcggctttaccctgagggtgggcagctgctggatgagaagttccaggcagcctatagcctcacctacaataccatcgccatgcacagtggtgtggacacctccgtgctccgcagggccatctggaactatatccactgcgtctttggcatcagatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429484 - DNA, 2004 bp, Homo sapiens
gggggaggtgaaccagctcctcataatcatagtcatcatatctgatgccaaagacgcagtggatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429485 - DNA, 2045 bp, Homo sapiens
agtgttgggattacaggcgtgagccaccgcacctggccattttacctttagggaatacagagcttagtcatgataggaatgaatgtgcttgtccttgtactaaactgctcagagccttagcagatgctggggcagctctgtaggaaaggaaatggtgaggtaagtgggtcagggatcaaggcagtctgggaggggtgtgggggtgaggagtgacatcagttgccaacatgccttcctctgtgccccaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429486 - DNA, 1391 bp, Homo sapiens
  misc_feature (10)..(10): n is a, c, g, or t
  misc_feature (16)..(16): n is a, c, g, or t
  misc_feature (21)..(22): n is a, c, g, or t
  misc_feature (39)..(39): n is a, c, g, or t
atgtacttgncctctntcctnnggcctcaaaccattaancatggagaaaagggaaaaagggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429487 - DNA, 749 bp, Homo sapiens
  misc_feature (651)..(651): n is a, c, g, or t
  misc_feature (681)..(681): n is a, c, g, or t
  misc_feature (741)..(741): n is a, c, g, or t
cggggaccgcagcgggctgaactgctggtgtcagagcccggcgagcgctggcagttccgcggcggggatgctgaggagcgctgggtccgggagcagccctggcccctgcggacttccgaggccgtgaaaacccctgcgctgcggcccttcccaggcccccgaggccgttcgccgttcccgaagcccgactgggggaagagtccagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcaccatgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttttacncatgctttcttgggcggccttgcacttacncttgcttgcttgcactaccgggattggtcccctttggcccaagcttccttgggcgcccanttacattt

SEQ ID NO: 429488 - DNA, 3533 bp, Homo sapiens
tcggtgcattgtacggtccgggcgtatttggatatgtcgaccaggctgtctgccactgcgtcgggccggggatgctgaggagcgctgggtccgggagcagccctggcccctgcggacttccgaggccgtgaaaacccctgcgctgcggcccttcccaggcccccgaggccgttcgccgttcccgaagcccgactgggggaagagtccagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcaccatgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctgggggctttgagtctgcccgcgacgtggaggcgctgatggagcgcatgcagcagctgcaggagagcctgctgcgggatgaggggacgtcccaggaggagatggagagccgctttgagctggagaagtcagagagcctgctggtgaccccctcagctgacatcctggagccctctccacacccagacatgctgtgctttgtggaagaccctactttcggatatgaggacttcactcggagaggggctcaggcaccccctaccttccgggcccaggattatacctgggaagaccatggctactcgctgatccagcggctttaccctgagggtgggcagctgctggatgagaagttccaggcagcctatagcctcacctacaataccatcgccatgcacagtggtgtggacacctccgtgctccgcagggccatctggaactatatccactgcgtctttggcatcagatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429489 - DNA, 3017 bp, Homo sapiens
cggggaccgcagcgggctgaactgctggtgtcagagcccggcgagcgctggcagttccgcggcggggatgctgaggagcgctgggtccgggagcagccctggcccctgcggacttccgaggccgtgaaaacccctgcgctgcggcccttcccaggcccccgaggccgttcgccgttcccgaagcccgactgggggaagagtccagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcaccatgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctgggggctttgagtctgcccgcgacgtggaggcgctgatggagcgcatgcagcagctgcaggagagcctgctgcgggatgaggggacgtcccaggaggagatggagagccgctttgagctggagaagtcagagagcctgctggtgaccccctcagctgacatcctggagccctctccacacccagacatgctgtgctttgtggaagaccctactttcggatatgaggattctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcatactccctttttatgggctgtt

SEQ ID NO: 429490 - DNA, 450 bp, Homo sapiens
agcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggtgagcctctctgggcctgacacttggagaggtggctttgtggtgggttctgtcctttgatctcttttctgggagctttgtgagctgattccatagacaagcagggaaagccctggctttatctaactgtagagttttgggttttttgtttttattttttctcagaaggaaaattttaggttttgaagaaaggcatcgttagtgcttgtgttaggtacagattggcaaactgaggtgcaaaaaggaatcaggtggcctgcaagctggtggcagagctggggtt

SEQ ID NO: 429491 - DNA, 992 bp, Homo sapiens
gcttgctgcttcctgaggccgcgtcagggtattgggttaggcagagatgctgaggcaaccctcatttcaccctcctcttcccctctggacacaagatacctgatacctggggctttctctcctgacatcgatgagagagtcacatttagggcagactagggacaccaggctttggactcagacctcctcagcatggcccaggccttgcatgctgaggctctgaaatccaggaaaaatggttgacctcatggacacttcctcaaactctctgcagcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429492 - DNA, 866 bp, Homo sapiens
  misc_feature (770)..(770): n is a, c, g, or t
  misc_feature (816)..(816): n is a, c, g, or t
  misc_feature (853)..(853): n is a, c, g, or t
gttattattcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagncactggggttctgaaccttcacgttgaatgtgaaagggttaccaanggattggaaggggatcccatctgggaaatgccaggtnccacttggcttgg

SEQ ID NO: 429493 - DNA, 611 bp, Homo sapiens
cctcatgagatagattccgtgccctgtgacctggggtgagcagctaacacttggggcgctgcagtctggggaggctgagtgcaccggcccccatgacccacagccgttgccttcacaaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagtaagttcccattcccccagagacccaggcatgtcttcctgtccctgctttatgcgccttgatgcatcttcccctgttccttccgttgcaggatggagaagtatccagtatgcatctcgtaagtgcctctgacattttctctgaatttgaatctataactgtctgtgcttgaatagtttccactcttaactctttccccaaggttgggaagtggtcttagatccctttgactaaggaaagaaaatagatgtgccaattcctagtcattgcca

SEQ ID NO: 429494 - DNA, 679 bp, Homo sapiens
gcatgttccctggaccaacaacctgagggactatattcctttttccttttttcttctccaactcttgtgatttggagcagaaaagttcccttgacttccttcgtgggtaggaagacgcataaagggtggaggtgaagggaaggagacacacactgagtaatactgcagggagagtgaggatggaaatgccaaggagaggaggtgatgcctgcccaaagaactttgtccttcccaggcttctcatgccacctactgcctgtatctcctcaaaggatttaatgcttccaagctttggcctccacatttttagatgatgattgcaatctgtttttcatgggggttgaggtgaagactgaaggaataatgaacatgcttggcagaaacctagcaagaaatagatggtgagctcaaactgggtagttggacaaggtttccagaaagaagggttaagggaaagcaacaaggaaaagtgcagtgcccccatggttcccaacagtggggagctgtctccacccctagcctgggagggctaaaaaggggaggcaattactggaacccagagaaagaggtagcttaacgagggagcttcctgagaagagtcctcgggccttgttagagcaccaccagctgctgctggcagggaggaagcaggaaattaaacggtgtgtatctcctttct

SEQ ID NO: 429495 - DNA, 192 bp, Homo sapiens
cttattttccttctttatcgcttattttccttctttgttaaaccaatattcctttcaactgctgcctgctagggaaaaactactcctcattatcatcattattattgctctccactgtatcccctctacctggcatgtgcttgtcaagttctagttgttcaataaatttgttaataatgctgactcttcaac

SEQ ID NO: 429496 - DNA, 521 bp, Homo sapiens
cctcatgagatagattccgtgccctgtgacctggggtgagcagctaacacttggggcgctgcagtctggggaggctgagtgcaccggcccccatgacccacagccgttgccttcacaaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagaggtagctgaccttgggagtttatgatggagaagtatccagtatgcatctcgtaagtgcctctgacattttctctgaatttgaatctataactgtctgtgcttgaatagtttccactcttaactctttccccaaggttgggaagtggtcttagatccctttgactaaggaaagaaaatagatgtgccaattcctagtcattgcca

SEQ ID NO: 429497 - DNA, 3774 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429498 - DNA, 3720 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaacactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429499 - DNA, 4056 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429500 - DNA, 3573 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429501 - DNA, 3855 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429502 - DNA, 3855 bp, Homo sapiens; identical to SEQ ID NO: 429501

SEQ ID NO: 429503 - DNA, 4100 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctgaaaaaaaaaaaaaaaaaaaaaaaaaaaaaaaaaaaatgtgtgggggggccggggcccggaaaagacttttgaagaaccatcgcgtggggggggcggcgggccccagtagaggttagagtgtgaaacgggggccataaggcgggtcccatagggaaaccgcgggccaggaacaagggcgcgggggattctctcccaccagataaaaaagcgcccggggggcaaaccagagcggtttcgtgaaacaaatcccagaaggggagctccgggggggccactagggggtctctatcaccggggattccaggcgaaccgaattcaaatagcgga

SEQ ID NO: 429504 - DNA, 3663 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagagagcctccaggaggaactcagtaagttaccattcccccagagatccagacatgtcttcctatcctcgctttgagcaccttgatgactcttccctgttcattccattgcagagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429505 - DNA, 3043 bp, Homo sapiens
  misc_feature (1136)..(1137): n is a, c, g, or t
  misc_feature (1139)..(1139): n is a, c, g, or t
  misc_feature (1142)..(1142): n is a, c, g, or t
  misc_feature (1147)..(1147): n is a, c, g, or t
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagnnanccnccagnaggaactaagagaggaaaaaaatccagtacttgactcgtggagaggagtcttcgtccgataccaataagtcagcctgatgctctaatggaaaaatggccctcttcaagcctggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429506 - DNA, 3684 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429507 - DNA, 3483 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429508 - DNA, 2207 bp, Homo sapiens
gttactattcctgtctgctttgtaaagtcaatacactaaaccttcacaccaaaatgagttaccaacccgagatctccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429509 - DNA, 2695 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429510 - DNA, 2062 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcagtaagttaccattcccccagagatccagacatgtcttcctatcctcgctttgagcaccttgatgactcttccctgttcattccattgcagagaggaaaaaaatccagtacttgactcgtgagtggctttgacattttctctgaattcaaatctgttactctctctctgcttcattattttccagcccataagtcatagcccagggttgaaaagtggtcttggatccctttacccagaaaaagaaaacaagtgtggctctttggagaaaccacccagtgctttttctctctagaaaaaaaaaaaaaaaaaaaagaggtcttcaatctctttgtactaggggctacagacccttaagctctaaaaagcactgaggaatatccaggggtacacttcaaaaggaagagggaagagaaggatgaggtgcattttctatggcaggaaacttacttgttgtttcccataatctagaggctgttgaaaggaaaacaagaatggaagatttaagaaataagaaaatcagaaaagagagagggagggagaaaagtgtgtctaataaagaggagtagctacagtggctcagttggtacagatagatcataactgctttcaaaaactagtccctgaaattgctcattaaatttcccaaattctttttagagcaaggtacgaaatgatacagattgagaaggatgaatcttgtactcctaggcatacacatatagacatggtgacacctatgcccaggtacacattcaaaacagatgagctggaccccattgggaaggaactctcacagtgcctgccctgccactagcgttcaaccgatgttcccagacttgatattaagaagaggtgaagaaagaattgtacctgaagatggagaccatggggaagggtgggatggta

SEQ ID NO: 429511 - DNA, 1996 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaataaaaaaaaaaaaaaaaaaaaaaaaaaaaaaaaaaagcaaaaaaaaaaaacaaaaaaaaaaaaaaaaaaagacaaaaaaaaaaaaaaaaaaaaaaaaaacaaagtcagggcggcgcgcgcgccgcggcacccacaagaagacccacaacaccgacggggggggcgccgcgcccacggaagaaagaaaaaaggggaaacagggtcgtgtacacaaacagagagccgggcggcgcaagaacaagggaggagtgacacccaaacaaaaaaaagacacccggcggggggaacaagcgggcttggcaaacaacacacagatgggagaggcgagagagagaaaacggcggacaacaacaaaggggggcgcacgagagcggcggcgagcataaatgcacgccgg

SEQ ID NO: 429512 - DNA, 1795 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagagagcctccaggaggaactcaagaggaaaaaaatccagtacttgactcgtggagaggagtcttcgtccgataccaataagtcagcctgatgctctaatggaaaaatggccctcttcaagcctgggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaataaaaaaaaaaaaaaaaaaaaaaaaaaaaaaaaaaagcaaaaaaaaaaaacaaaaaaaaaaaaaaaaaaagacaaaaaaaaaaaaaaaaaaaaaaaaaacaaagtcagggcggcgcgcgcgccgcggcacccacaagaagacccacaacaccgacggggggggcgccgcgcccacggaagaaagaaaaaaggggaaacagggtcgtgtacacaaacagagagccgggcggcgcaagaacaagggaggagtgacacccaaacaaaaaaaagacacccggcggggggaacaagcgggcttggcaaacaacacacagatgggagaggcgagagagagaaaacggcggacaacaacaaaggggggcgcacgagagcggcggcgagcataaatgcacgccgg

SEQ ID NO: 429513 - DNA, 1294 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctggtgaggaaatgcttcagatgaggctccactttgttaaataaaatggatgaatgaaaa

SEQ ID NO: 429514 - DNA, 1933 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429515 - DNA, 2077 bp, Homo sapiens
tccacctatctgcttagcagtgtctcgtgacattcacctctgtctgtcccttgcaggatggagaagaacattcttacatgctgaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429516 - DNA, 1885 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcttcccccttgtgctgacagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429517 - DNA, 1753 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagctcagttttctgtgcttggaccctctgggcccatcctggccatgatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429518 - DNA, 1867 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagagatcctcccccttgtgcctacagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429519 - DNA, 1044 bp, Homo sapiens
tccacctatctgcttagcagtgtctcgtgacattcacctctgtctgtcccttgcaggatggagaagaacattcttacatgctgaaggagatttaaccatagtagaaagaatggagaactattaactgcctttcttctgtgggctgtgattttcagaggggaatgctaagagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagcctggatcgcagcctgggagggaccgcctatcttgctggtgatctcggcggagcagttatcttgtgggaccccggaagggattactggcgtccgtgggacaatgggcaattac

SEQ ID NO: 429520 - DNA, 543 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagcacagccctaccccgccccagtatcatgcgatggtcccccacaccggttccctgaacccctcttggattaaggaagactgaagacttactttcctcctccctgtgttaactggggctgttggggacagtgcgtgatttctcagtgatttcctacagtgttgttccctccctcaaggctgggaggagataaacaccaacccaggaattctcaataaatttttattacttaacgctgaaaa

SEQ ID NO: 429521 - DNA, 902 bp, Homo sapiens
atctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctctgcagagtgtcttggttgagagaataacctcaccgtacccacatgacacgtgatttggaaagagactagaggccacacttgataaatcatggggaacagatgtgttccacccaacaaatgtgataagtgatcgtgcagccagagccagccttccttcaatcaaggtttccaggcagagcaaataccctagagattctctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctccca

SEQ ID NO: 429522 - DNA, 286 bp, Homo sapiens
gcgactcttactgtttctcatggtgagaagacaatatttgctttctctttttcctttcttccggatgagaggctaagccataatagaaagaatggagaattattgattgaccgtctttattctgtgggctctgattctccaatgggaataccaaggggtaagtgcaggaaattgattagagcctgggctacaacgcatgggaggagcggggctgaatcgctgagagtggtgagtgggcatgcagggagagtactctcccagagaaaggggtgcagtgcctgtgtgt

SEQ ID NO: 429523 - DNA, 627 bp, Homo sapiens
ctggccatgcatcctgcaccccccatgacacagggagccaagcctgacatttttgagaaggtgccacctctgatccatcagagctgtagaggagggaagctggaccctggaagagactctaaagaaaaggagagaaaacatgtagtgagaggagaatggagtgggaaaagtacaaaaatactgacctttttcttatctgtgtctccttcctttcagaatggaaaaatggccctcttcaagcctggtgagtaaatcactgcatgttccctggaccaacaacctgagggactatattcctttttccttttttcttctccaactcttgtgatttggagcagaaaagttcccttgacttccttcgtgggtaggaagacgcataaagggtggaggtgaagggaaggagacacacactgagtaatactgcagggagagtgaggatggaaatgccaaggagaggaggtgatgcctgcccaaagaactttgtccttcccaggcttctcatgccacctactgcctgtatctcctcaaaggatttaatgcttccaagctttggcctccacatttttagatgatgattgcaatctgtttttcatgggggttgaggtgaagactgaaggaataatgaac

SEQ ID NO: 429524 - DNA, 4086 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcttttcccaggatggctccaggataaggatcactgtaggtggttgtggagttgacacccctgttgactccttcccagctgattgtcagagccttagacccagcacgccttggattagctctgcagagtgtcttggttgagagaataacctcaccgtacccacatgacacgtgatttggaaagagactagaggccacacttgataaatcatggggaacagatgtgttccacccaacaaatgtgataagtgatcgtgcagccagagccagccttccttcaatcaaggtttccaggcagagcaaataccctagagattctctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctgactcttcaac

SEQ ID NO: 429525 - DNA, 3717 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaaggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429526 - DNA, 2940 bp, Homo sapiens
ctagaggttacccagttccttctctaaatttcccttcatgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagagagcctccaggaggaactcaagaggaaaaaaatccagtacttgactcgtggagaggagtcttcgtccgataccaataagtcagcctgatgctctaatggaaaaatggccctcttcaagcctggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429527 - DNA, 1726 bp, Homo sapiens
gtcagcatttttcctggatttaagagcacagcatgcaaggttgggcatgctgaggaggtcttccagaaacccgtgtccctagcctgccctgaatgttgatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctga

SEQ ID NO: 429528 - DNA, 1972 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagagagagcctccaggaggaactcaagaggaaaaaaatccagtacttgactcgtgagtggctttgacattttctctgaattcaaatctgttactctctctctgcttcattattttccagcccataagtcatagcccagggttgaaaagtggtcttggatccctttacccagaaaaagaaaacaagtgtggctctttggagaaaccacccagtgctttttctctctagaaaaaaaaaaaaaaaaaaaagaggtcttcaatctctttgtactaggggctacagacccttaagctctaaaaagcactgaggaatatccaggggtacacttcaaaaggaagagggaagagaaggatgaggtgcattttctatggcaggaaacttacttgttgtttcccataatctagaggctgttgaaaggaaaacaagaatggaagatttaagaaataagaaaatcagaaaagagagagggagggagaaaagtgtgtctaataaagaggagtagctacagtggctcagttggtacagatagatcataactgctttcaaaaactagtccctgaaattgctcattaaatttcccaaattctttttagagcaaggtacgaaatgatacagattgagaaggatgaatcttgtactcctaggcatacacatatagacatggtgacacctatgcccaggtacacattcaaaacagatgagctggaccccattgggaaggaactctcacagtgcctgccctgccactagcgttcaaccgatgttcccagacttgatattaagaagaggtgaagaaagaattgtacctgaagatggagaccatggggaagggtgggatggta

SEQ ID NO: 429529 - DNA, 1955 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429530 - DNA, 1268 bp, Homo sapiens
tccacctatctgcttagcagtgtctcgtgacattcacctctgtctgtcccttgcaggatggagaagaacattcttacatgctgaaggagatttaaccatagtagaaagaatggagaactattaactgcctttcttctgtgggctgtgattttcagaggggaatgctaagagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctggtgaggaaatgcttcagatgaggctccactttgttaaataaaatggatgaatgaaaa

SEQ ID NO: 429531 - DNA, 2050 bp, Homo sapiens
gttattattcctcacgatgacccgacagtctctgctttctttttcctttcttccagaaggagatttaaccatagtagaaagaatggagaactattaactgcctttcttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429532 - DNA, 1206 bp, Homo sapiens
ctcttactgtttctcatggtgagaagacaatatttgctttctctttttcctttcttccggatgagaggctaagccataatagaaagaatggagaattattgattgaccgtctttattctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcaggtcagtacctgcttggcctcaggttttctgagctgggctgtggcagttgaatgaagggggaggtgttagtgtctgcagtcaacctgggtctctgcactgaatataaggcccaaagcacagacctggaggctcctccttgcaccgggggagcttctcttctccataaagctgttcatgacgcaaacatttactgaacatttcctgtctgccagaagtataacagtaattggaattaggggataattgttaagataagctgcgtatgtaaagtc

SEQ ID NO: 429533 - DNA, 1097 bp, Homo sapiens
tccacctatctgcttagcagtgtctcgtgacattcacctctgtctgtcccttgcaggatggagaagaacattcttacatgctgaaggagatttaaccatagtagaaagaatggagaactattaactgcctttcttctgtgggctgtgattttcagaggggaatgctaagagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacctgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctgactcttcaac

SEQ ID NO: 429534 - DNA, 1457 bp, Homo sapiens
accctgggatactgcactcattcatgtagctttctcctcactaggaccacacttttgtaagcagctctaaaatgaaattgttcttgaattatggaatgtgagtgtgccatgattccttttgagaccctctctgatacaggcctctcaagaatttaggctaattcatccttccacagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429535 - DNA, 871 bp, Homo sapiens
tggaccggattttgggctgtagcacaatgaagcaagaacaatgcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacg

SEQ ID NO: 429536 - DNA, 645 bp, Homo sapiens
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgt

SEQ ID NO: 429537 - DNA, 5868 bp, Homo sapiens
  misc_feature (3330)..(3330): n is a, c, g, or t
  misc_feature (3364)..(3364): n is a, c, g, or t
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggcccngtccatcttctccccaccaccgccccggtgtgcntacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429538 - DNA, 6938 bp, Homo sapiens
  misc_feature (1948)..(1948): n is a, c, g, or t
  misc_feature (4400)..(4400): n is a, c, g, or t
  misc_feature (4434)..(4434): n is a, c, g, or t
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcggtgagtgacttgagtggggatccaggcctctcattccctgctgggggttgtgggttctagagtcggggaatgagccctctgcatggggtaaggcactgcactccccacggcggggcactcccagagtggatggatcaaagatgatcacctcgtgcccttcctcaccaagccatatgctgggcgggcacacagagggcaccactgcccttgtctgatggaagaattcaagtctcagagagtgaagtgacttccccagtgttagtagcatccctggtctccagactcagtccggtcctgagtttaaaagagcatctgggccgggcgcggtggctcatgcctgtaatcccagcactttgggaggccgagttgggcggatcacaaggtcaggagattgagaccatcctggctaacacagtgaaaccccgtctctactaaaaatacaaaaaattagccgggtgtggtggtgggcacctgtagtcccagctactcgngaggctgaggcagaagaatggcatgaacccgggaggcagagtttgcagtgagccgagatcgcgccactgcattccagcctgggcgacagagcgagactccgtctcaaaaaaaagaaaataataataaaagaacatctgatgaggggccaggcgtggtggctcatgcctataatcccagcactttgggaggccgaggtgtgcagatcacaaggtcaggagttcgagaccagcctggccaacatggtgataccccgtctctattaaaaatacaaaaattagctgggtgtagtggcggacacctgtaatcccaggtactcaggaggctgaggcaggagaatcacttgaatccaggaggcggaggttgcagtgagctgaaatcgtgccattgcactccagcatgggcaacaagagcaaaactccatctcaaaaaaaaatcccttctatttatttagagacttgtatacttctacaaaagcaatcctgtggggtgagtggggtaggagtgattactgtactctgcaggtgtggagtgcagaagcgggccttgtatttggaaaggaattttcagccctgccaagtcctggcagcagggggtgcagcagaccctgcctcacctgcgttggggtgcagaagggggcctggtatttggaaaggacttcccagctctgccaagtcctggcagggggtgcagcagcccctggctcacctagctgtgttggggtggagcgaagccctgcctggctcatggggccagagccccacaggccgcagcggggtggcgagggtgctgcgggctgctatccccgcctggcggaacgtgtgtcctgttgcctctttgcagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggcccngtccatcttctccccaccaccgccccggtgtgcntacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429539 - DNA, 6059 bp, Homo sapiens
  misc_feature (1069)..(1069): n is a, c, g, or t
  misc_feature (3521)..(3521): n is a, c, g, or t
  misc_feature (3555)..(3555): n is a, c, g, or t
gtcggcagtcggacacagcccagggcactcgactgagagggcttaacgggactgtcggggcacggaggggacttcactcagcctcagggccaaaggaggcttcctggaggaagtgatgactaggcagggtcttgaaggaaaagttcacctgccaggcagaggaagcaggggcactagcctggcatggcatggcgcggggctggctgatgagcggagcagctggggtgggggccttggtctccgaggacctgggagcaagctaaggaacttgggctttctcctacgggcagcgggaagccctggcaagtttaagcaaagagtggacacactcaggctgggaggcgtctttacccctggggagtggagaggagaggatagagtcaggggttcagcaggagtaggagaggatgtgtggcctgggggcttctccgagtcagcaatacataaggggaagccctaggaaggcccctcacgcctcagagccagagccactgacccctgtgtcttctccctgcccagaggagaccaactcacaggaccaccgtccccctagcggtgctcagaaaccagccccctcggtgagtgacttgagtggggatccaggcctctcattccctgctgggggttgtgggttctagagtcggggaatgagccctctgcatggggtaaggcactgcactccccacggcggggcactcccagagtggatggatcaaagatgatcacctcgtgcccttcctcaccaagccatatgctgggcgggcacacagagggcaccactgcccttgtctgatggaagaattcaagtctcagagagtgaagtgacttccccagtgttagtagcatccctggtctccagactcagtccggtcctgagtttaaaagagcatctgggccgggcgcggtggctcatgcctgtaatcccagcactttgggaggccgagttgggcggatcacaaggtcaggagattgagaccatcctggctaacacagtgaaaccccgtctctactaaaaatacaaaaaattagccgggtgtggtggtgggcacctgtagtcccagctactcgngaggctgaggcagaagaatggcatgaacccgggaggcagagtttgcagtgagccgagatcgcgccactgcattccagcctgggcgacagagcgagactccgtctcaaaaaaaagaaaataataataaaagaacatctgatgaggggccaggcgtggtggctcatgcctataatcccagcactttgggaggccgaggtgtgcagatcacaaggtcaggagttcgagaccagcctggccaacatggtgataccccgtctctattaaaaatacaaaaattagctgggtgtagtggcggacacctgtaatcccaggtactcaggaggctgaggcaggagaatcacttgaatccaggaggcggaggttgcagtgagctgaaatcgtgccattgcactccagcatgggcaacaagagcaaaactccatctcaaaaaaaaatcccttctatttatttagagacttgtatacttctacaaaagcaatcctgtggggtgagtggggtaggagtgattactgtactctgcaggtgtggagtgcagaagcgggccttgtatttggaaaggaattttcagccctgccaagtcctggcagcagggggtgcagcagaccctgcctcacctgcgttggggtgcagaagggggcctggtatttggaaaggacttcccagctctgccaagtcctggcagggggtgcagcagcccctggctcacctagctgtgttggggtggagcgaagccctgcctggctcatggggccagagccccacaggccgcagcggggtggcgagggtgctgcgggctgctatccccgcctggcggaacgtgtgtcctgttgcctctttgcagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggcccngtccatcttctccccaccaccgccccggtgtgcntacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429540 - DNA, 5913 bp, Homo sapiens
  misc_feature (3330)..(3330): n is a, c, g, or t
  misc_feature (3364)..(3364): n is a, c, g, or t
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggcccngtccatcttctccccaccaccgccccggtgtgcntacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttgac

SEQ ID NO: 429541 - DNA, 1357 bp, Homo sapiens
gaaaagaggttggggggaacttctttttttaacccctatttttttcttttaaaaaaggggggattttctcccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429542 - DNA, 966 bp, Homo sapiens
tcactctctcaatcttatccatcatagcaggcagttgagtgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429543 - DNA, 968 bp, Homo sapiens
  misc_feature (30)..(30): n is a, c, g, or t
gcggccgcatactactactactactactanattcgcggccgtgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429544 - DNA, 1919 bp, Homo sapiens
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtgtaggggataacatacgtgatgttatccccaacaccagtttgccctcaatgtgagacatggagttaaaggagattatttcggagatttaaggtttaataattgccctgctggattttggacttgcatgaggcctgtactcattcaccaaactttgtttgggctgatttctcca

SEQ ID NO: 429545 - DNA, 392 bp, Homo sapiens
tccaacctggctgccaagcacagcttctacaacaacaagtgagtgggaccctcagcccaggctgaggcctaggggccagtggagagtcccctcaggcagctcagatggctgaggaaaggctgaactgaaagggtggatgtagggtgcaaggaaaggggcagaatttgggaatcaaatccagcctccacctggaaaggatgagaatcacatttgtcgaacatctactatattccaagcgtcatcttgggtatgttaattatcttagcaatcctgtgagggaggagttactggccctgttgtacagaacaaaaagctgaggcttggaagtagcttacttagcttactcagcttactcagcagacagcaagcggggggcctcgtctctgactgta

SEQ ID NO: 429546 - DNA, 293 bp, Homo sapiens
ggaacttctaatggattggggtccatagatgacatcgaaacaggtaatgtccccgatacgagggaacaagtggaaattggggccccgagaggtcaggggagtcgagccccctccccatcccagccctgtagatgggagggcctccgaggggttccccaccctggtactccctgaggcatgggagaaaacagtgggttgagagctacagacccactcaaggaggggagggcatctctagtctggcagagaggggtgctgcctcttagctaggtgcaacagtcccatggccttca

SEQ ID NO: 429547 - DNA, 5462 bp, Homo sapiens
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcaggtaggatcggggctgaaccaacctgtctcagtttatccgttatgagaggtttggattcactctctccgggtataaatgacctcaggcagtgggtccaggggcctccgcctccctaggaggtacctcccgtgtccacgggggcaggatgtggggacaggccatggctgctgttggcagggagtggtcattgccggggagccgccgggggcagcctcactcttgaaccctggccaggacacagtctgggcagcctggtcccacacgccttccttctgcctcctgccccacatttcctgctgtgttgccttttttctcaccagcctttctgcaggttcaggcccctgggcctcaaatgtcttcctcttccccaccctgcctttctctgtcttttcgcttttcaaagcccagctcaagggcatgcccctgccgtaacccatcctgctctccctggctcagtgactctgcttgggaggggcagccgagactgaggactctgacaaggaagagcccaactgggccctgcagccttggacaggtccttcagtttctgcattctgaaatgcggaccatccctcaacgggaacaagggaggaaagtgcttgataacctggcacacacgacccagcaggaaatgcagtgggcagtcactgtggatagctgctgtgctgtcctgagttggggactcctcccaagggccaagacacttgtgcaccccagtcaggcctggctcatcccagggggggtgaggcagggcctggcacacgactgagacccctgcccgctgctcaggtagactttgaggctttctggaaagtgagagatgggctataagagcactgatggagcctggggtcctgccaccttgtacattaagggaaactgaggcacagagtggggaggggacggggccagtgtcacacagcgaggcagcagcaggcctccctcctccagagctttgcagcactttctttcattcattccataaggaggcccacaaaacactctcggccctgggcctgagagagctgcgtccttgccctcagggacctcccagcctgcaaagtaggcagttgatgatctgcctttgtagcactcatggtttataatcagaaattataggtcaggcatggtggctcatgcctgtaatcccagcaatttgggaggccgaggtgggtgatcacttaatttcgggagttaaagaccagcctggccaacataatgaaaccccatccctgccaaaaatacaaaaattagccgggcatggtggcatgtgcctgtagttccagctacttgggaggctgaggcaggagaatcacttgaacccaggaggcacagtttgcagtgagccgagatcgcgccattacactccagcctgagagacagaatgagactccatctgaaaaataaaagaaattattaggcctggcacataccaggtgctccaacgagaaaacattaaatgaatgaaaggtgatttgtctaagtttacccagtatgggccaagcactgagcttggggttgggtatgtgataaacaaaacaaatctgtttcctgccctcaaagagctcacagtctaggatggacattaggacattaggcagatcatttctggtttcaaactgtgatgagggctgtgaaggcagagtatggggagacctgggccattgagactgggagccctgatttagacaggattcagtgacatttaagctgagaccggaaggttgaagagttaggggcagggtgtgcaggtgaaacagcattccagaccaggtggaaggtatgtgcaaaggccctgaggcctggaggagctcagagtgtgggaggaaccaacaccaaggcagagctgggggtcctggaacaggagatagaagccagaccgcttgacccctgataagaagctcagtcttagcattgggaaggcattgaggggaggcagcattaattctattcatttattcggaaggtatttattgagcactgctttgtacccagtgtcagttcagacactgggaatagagcaccaaggtagcgtctcatcacagcaagtggagctgggctgggcaggcacagcagatgctcaaaaaatatttgttgaatgattgaatgactgcggccagggggccacagcaaatatgggctgaatgcccagctctccagggccaaggccgcaaagccttgcttagtctgcagccagatgaccacagatggtgccatacctggcaccaggccccccccagtccctgccaggctgttcacccatccctgcaatcttgctgggctcctcctgcacattcatagaggtcaggaggggcatggttagggagggctctaagaagcccacagtggagaggaccagttcagaccctgcctcatgaactcagtttgcccaacatggtacagcacacatgtgagcacacacatgtgcacatgcacaaacggagtgccctaggacacatgagggcagggtggtgtcccagccagagcccctggccttccgtgagttgtgcacagacacaagtaaatgcaggctgcaggggtccctgtaggttctccaccatgagcaccatattcattcagccggctggtcatttcacatgtgcacctggaagtggggatggaccaggctgtgcccacagggagcttcttatgacctaggagccaggcagaggccctgcaagacagtgtctgtgcaagagctgtccctggcatcgtggggaacaagatgcaaggagggctgtgagttccaggaacagagagcccaaggcagccttggttggaaagggcttcagcgagccagggaagcaagactaagaggaagggagagctggagagggggaaatggcactcatgaccaggagcacagcctgcacaaaggctaagcagcaaaagagacagacaccccagatcacaagaccagttcctcctatggggctcggaatagcctgggctctgcagtggaacgtgcgttggatcagatcctgagcacgctccttatctacgcaggccactccacccctcagagccttggcttccttctcttttgcaggggtccggtacctgccattttgtgggggttatagaattacaatgggtcaatgtgaaagctcccagcagggcgtctgcagaagagatagagctccatagacctttgttgccaaacagatgtcaccagaaggagtgccatgcagaagggcaggaacagtgagcctggcaggctggggtgatggcatgggcaggagggctgagaaggtgactttgtcctgcgtggcctgggagccatgggcaggatctagcagggagaatcaccgctttccctagagatgttcatctggtacctctctttccctcaaagactttatgtacttaccatgaggatagcagctctgtgatccagcgtggcggccttggtttggcagccaatctatggtgggcagacactccggagactgaagtgcacacatttgccatgtgctctatggcaggctcaggtgtgggaaggaggtgcagggtgttggtgcaggtatggatgggggagtgtacagttccaggggacagagtcaggacaggctcttgggtcagacagccctgctctgatctgtgcatagcagctttctgggctgacatttccatgccgtgggatgatacctcgcagggcgcctggaccgagggctaaaccccacagtgggtgtgagatgctggcctgggctggcgtgaggcaggatgctggatgagtctagctgctggtcctgtggctgctggtcctgagaaaggaaggctagtggtggagtctggtcctccatccggctctccgtggggacacagaaagggtggggccacccagggcctcaccagggaagcaggacttgagctggactgtgaaggactcagagaaaaaggggagggtgttcaggacagggaaggatgcaccacagcctggaggttggagtgtgggaactgttgaacgaaacagcagctctcccagcccaacttccagaaactgtgcatctaatcaacacaggccgggcacggtggctcacgccagtaatcccagcacattgggaggccaaggcgggtggatcatttgaagtcaggagtttgagatcaacctggctaacatggtgaaaccccatctctactaaaaaattcaaaaattagctgggcgcggtggctcacacctataatcccagcactctgggaggccgaggcgggtggatcacgaggtcaggatatcgagaccatcctggctaacacggtgaaaccccatctctactaaaaatacaaaaaattagccaggcgtggtggcgggtgcctgtagtcccagctagtctggaggctgaggcaggagaatggcatgaacccaggaggcggagcttacagtgagctgagatcgtgccactgcactccagcctgggctacagagtgagactccatctcaaagaaaaaaaatatatatatatatattcaaaaattagctgggcatggtggcatgcttctgtaatcccagctactcaggaggccgagattagagaatcacttgaatgtgggagtcggaggttgtaatgagctgagatcacaccattgcactgcagcctgggtgaccaaacgagactccatctc

SEQ ID NO: 429548 - DNA, 6036 bp, Homo sapiens
  misc_feature (3498)..(3498): n is a, c, g, or t
  misc_feature (3532)..(3532): n is a, c, g, or t
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatggtaacgcctccgccctgcatgctcggggctgcggtcggggctgtggtctgagcctcacctgggaggggcagcctggagggcccagccggccagcgctcagcctctccgaggtgggtggtccgggcagaggtgtgggggagcaggcacccatgatggctgtgctcccagatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggcccngtccatcttctccccaccaccgccccggtgtgcntacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429549 - DNA, 5809 bp, Homo sapiens
  misc_feature (3271)..(3271): n is a, c, g, or t
  misc_feature (3305)..(3305): n is a, c, g, or t
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatgatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttgccggtgccaccccagaagcccctgctgctgctgccaccgccaccactggggagtagggccaggtgttggccgtgggtgaagtcctggggtcagggggtggggtggggccagaaggcctgatagaagggtcagggcaggccaggggggtggggggccgccctcatcaggcagcccccagccccctgaggcccngtccatcttctccccaccaccgccccggtgtgcntacccaggcgcacgtgctgcagcccccggaggccccgctgaaacctgggctgcccttcccccacccccacggctctcctggttgaggagggaggggcctggctgacccctccagcttcagcctccagctttaacttctgtctgctcctaatgggggcccaaagctcagggctggggagcctggggtccccacttgaatctccagcaggagggtccttctctccctggcccgtcctcctcccaccccctccccctgggggcaaatcaggacacaacagagggcagaggccccattagctttaaaatgtagccccaggttggagctgggaacactgtactggccacttaccctctggggcctcagctttccctccggaaggctgggaggaggtgggctagatgatctttggagcttaaggagtcccagccctttctctgatgccaccacctgaaccctgctccctcgtgggccagtgaaaatagactgtaggtcctcagagccttcagagatgatccagcccaaaccccattttgcagagaggaaaactgaggcctagaagggaggagtggtccacccacggtcccagcacaaggcagagctgggatgaaaacagggctgaaaagactcagggccaattattggctgagcccacggtcccctcagcagggatgcgatggtctctgaatcagtgtgcagctggggtcccaggcagcgctgcctgggggctggggaggggaggcccagaggagggctggccatgtgagcaccccatgaagggaccgccccctcccaaggatggtccctttgggtgcagcagcagaggtcacctcctgacatgcgctctgggaaaggtggcagagggcaggacaccatgagctcaggatctgtgtgaggtgtgggaggtgggaagggtgagggtctgggggaatgcggagaaaagggaggcttgaccccgggcaccatgggccactccaggatgggacacggcccctctttcttggggacccagtatgtcctctcctctagacccagacatacagttataaccgtctgtcctagcccctccctaatccctggccctcccagctgtctgggacttcagtggacccccagcccctgcccccactcaccaaggcctcgctcgtccctctcgtctgacatgtctgtgtgcacccccctcctctccaccctaccttccatcaaccagggcagatccaccgtgccctggttccccagacattccagaatgccccacatcattggcacaggagtggggcagccccggaaggaaccagggattaggctgtaggggggtgagaaggagagaagggaccaccccattcttctcaagcaaggattgccagcgcgcgctgacacagtgatgggctgcccagggctggaggggacgctgttcctcccgccgccactgcccaacctttcctgataatcgtggcatgcgccctttcctcttccctgccccaccccctggccgcagcaggccagcactgcagagtttgggtgctggtggtgtggctgtaggggaggggagaccacacccaaggtgggggctgtggccatgtgtggccgtgatgtcgatgatactcgttttccctgatccgtggtgttgcagtccgttgtcaccagccttgtttctagtgtgtatatatgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttg

SEQ ID NO: 429550 - DNA, 3614 bp, Homo sapiens
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaaggcacgcgctctcaatgaactgggacgccacaaggaggcctacgagtgcagcagccggtgttccctcgccctgccccacgatgaaagcgtgactcagcttggtcaggagctggcccagaaactggggctgcgagttcgcaaggcgtataagaggccccaggaattggaaaccttttctctgctcagtaacggcactgcggctggcgtggcagatcagggaacttctaatggattggggtccatagatgacatcgaaacagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctgtctctggtccagggtggcctgtctggcagcggcgtgcctagtgagttgccccagctgatacccgtgttccccggcgggaccccactgctaccacctgtggtgggtggctccatccctgtctccagcccactgccccccgcctccttcggcttggtcatggacccctccaagaagctggccgcctctgtgctggatgccctcgatcccccgggccccacgctggaccccctggacctgctgccgtactcggagacccggctggatgcactcgacagctttgggtcgacacgaggctccctggacaaacctgactccttcatggaggagaccaactcacaggaccaccgtccccctagcggtgctcagaaaccagccccctcgccagagccctgcatgcccaacactgccttgctcatcaagaaccccttggctgccacccacgagttcaagcaggcctgccagctctgctaccccaagacaggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgagatctgctttgacagtaaaccccggatcatcagcaaaggcaccaaggactctccgtctgtctgctccaacctggctgccaagcacagcttctacaacaacaagtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggcatgacccacgaagacatcgttcaggagtctaagaagtactggcagcagatggaggcgcatgcggggaaggccagcagcagcatgggtgctccgaggacacatgggcccagcacctttgacctgcagatgaagtttgtatgtggccagtgctggagaaacgggcaggtggtggagcctgacaaggacctcaagtactgtagtgccaaggcccggcactgctggaccaaggagcggcgggtccttctggtgatgtccaaggccaagaggaaatgggtgtcagtgaggccactgccatccattcgtaacttcccacagcaatacgatctctgcatccatgcacagaacggccgcaagtgccaatatgtggggaactgctccttcgcacacagcccggaggagagggacatgtggaccttcatgaaggagaacaagatcctggacatgcagcagacctatgacatgtggctgaaaaaacacaacccaggaaagcctggagaagggacccccatcagttctcgggaaggggagaagcagatccagatgcccacggactacgcggacatcatggtaacgcctccgccctgcatgctcggggctgcggtcggggctgtggtctgagcctcacctgggaggggcagcctggagggcccagccggccagcgctcagcctctccgaggtgggtggtccgggcagaggtgtgggggagcaggcacccatgatggctgtgctcccagatgggctaccactgctggctctgcggcaagaacagcaacagcaagaagcagtggcagcagcacatccagtccgagaagcacaaggagaaggtcttcacgtccgacagtgacgccagcggctgggccttccgcttccccatgggcgagttccggctctgcgacaggctccagaagggcaaagcctgcccagatggggacaagtgccgctgcgcccatggacaggaggagctcaacgagtggctggaccggcgcgaggtgctgaagcagaagttggccaaggctcgcaaggacatgctgctgtgcccacgggacgacgactttggcaaatacaacttcctgctgcaagaggacggggaccttcctctggagttgggccacccagcagctggactcctttctgactgcccccagccaaacttctcttggcattcagatgttcctcctcttctctttttctctgccacgttgttccaccattccatcatctggtctgctggcttgctggtctgtccctggagcctgggattcatggcttatatgggtgcaggacaggaggcatggcgggccaaaaggcaacttttggggcataaaaacaggaatgcctattctcatttagggccccaggatccaggcttggaggctgggcctttgcatggagatcatcctctt

SEQ ID NO: 429551 - DNA, 860 bp, Homo sapiens
tgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggagagactgatggagaggcagaaacggaaggcggacatcgagaaagggctgcagttcattcagtcgacactacccctaaagcaagaagaatatgaggcctttctgctcaagctggtgcagaatctgtttgctgagggcaatgatctgttccgggagaaggactataagcaggctctggtgcagtacatggaagggctgaacgtggccgactacgctgcctctgaccaggtggccctgccccgggagctgctgtgcaagctgcatgtcaatagggccgcctgctacttcaccatgggcctgtatgagaaggcgctggaggacagcgagaaggcgctgggcctggacagtgagagtatccgggcgttgttccgcaagagaggattggaggcatctaaagtatccagttgtggggccaaagaacgcacatgttctgacaaggaagtgacgccactgctgtttcttctcttgcagggagtacagaagtaggtttacgagtgaagagaccctgatgttctgcatgagggtgatggtgggagtcatcatcctctatgaccatgtccaccctgtgggagctttctgcaagacatccaagatcgatatgaaaggctg

SEQ ID NO: 429552 - DNA, 3364 bp, Homo sapiens
  misc_feature (903)..(903): n is a, c, g, or t
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgcncgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcctgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaa

SEQ ID NO: 429553 - DNA, 3166 bp, Homo sapiens
  misc_feature (705)..(705): n is a, c, g, or t
atgctccccgatttcccttctcctagcacctgggcccctgggctactgctgccctctggcccagccctgctatctccctccgtcctgcaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgcncgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcctgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaa

SEQ ID NO: 429554 - DNA, 1363 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaa

SEQ ID NO: 429555 - DNA, 367 bp, Homo sapiens
gtgggagtgtgggggactggggaccggggactgggggatagggttaggccacggagtccgacggggccaggctggcaggggtgtccagtaggtgggaggcaggggtggcgccaggcctcctttgacacagggacttctgcccacctctgctctagttccagcgctgcagccatttcttccagatgaagaacatctccttctgcggctgccatccccgcaacagctggtgagagtctgaccgtccccgagtcccccaaccgcccccacaaaccctgagagtccaaccgccccctgagtccccacagaccctgagggctgcccgtgcccagccctgagagctccacctgcacccacttagctctgtgag

SEQ ID NO: 429556 - DNA, 2221 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcctgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaa

SEQ ID NO: 429557 - DNA, 1137 bp, Homo sapiens
ggtgcccagccctgtgcttgggctgaaaccaaaaaaagacaacttcagatcttgaaattgtgcgacccccacactcctgtcccttaccctctccccaagccctttgttcctgcctcttctctctacatcatttgtggggtggccaaggctgggccagggctctgacgtgccctccacactgacttgcccgcagctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaa

SEQ ID NO: 429558 - DNA, 1691 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 429559 - DNA, 564 bp, Homo sapiens
taatgactgctttgcatttgggagaaagtgaccaatatctgtgctgtctcccgaggtcagaggtttgtttaatgaagaagtgggttgcatccaggttgactccttgttttctgtcctcctgtgtccagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttcaaaaaaaaccccacaaagggcggccgct

SEQ ID NO: 429560 - DNA, 491 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggtgagcgggtcgggcgggggtggccaggccgggcatcggcacctccagccgctacgcacctttctctgggcccgaggctgccctcgccccgagcgcccgggacctcgtagaggctcacccgcaccccgcggagtttggggtccccgaggcgcggattcc

SEQ ID NO: 429561 - DNA, 379 bp, Homo sapiens
gcctccattctctgtggtttagctgaaattccatggggaaattcaagtgacttactcaagtgaatttatcaaactggaatgtgcatttctcaaccctcgatgtcctttcacagccatacttagactcttcctgcctttttaaattgtttctattattacatatttatagatttatatctgcacttgatctgtgactttgtaatttgtaagaaaactctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttggagttgtg

SEQ ID NO: 429562 - DNA, 2229 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagtaggtgagagtcatttttttcttatttctgcttggtttcaatttcgaccccagagataaaatggctagtccactgctgcgatgatgtgtgctgatcgtacacaggcctgggcaaagctggggctgccgaccctctgggtagaggagagaggggccaaggtcagggcaagtcctcagggtgttcgccagcctcgaggtggcagggtgagactctgcatgttgaatccaagccactcagtcaagacgtcataattgggattgtttctcgttttgttttgtattttgtttttcaaagctagcgctagctaaaatcattttatttgggttttatttgggttgtttctttttcttacctagaagcattattcccatttgaacttaataccttcagttcttgtgagtgaggtgactgccctggagacttagctcctctgtttatccacagaacagatacagcacgggcagcggcagtgcaagccacccacagccaccccgtgccactgtgtcccaaccctgacctggagggaccagctctcggggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 429563 - DNA, 1719 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttcaaaaaaaaccccacaaagggcggccgct

SEQ ID NO: 429564 - DNA, 6032 bp, Homo sapiens
  misc_feature (4194)..(4194): n is a, c, g, or t
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagtaggtgagagtcatttttttcttatttctgcttggtttcaatttcgaccccagagataaaatggctagtccactgctgcgatgatgtgtgctgatcgtacacaggcctgggcaaagctggggctgccgaccctctgggtagaggagagaggggccaaggtcagggcaagtcctcagggtgttcgccagcctcgaggtggcagggtgagactctgcatgttgaatccaagccactcagtcaagacgtcataattgggattgtttctcgttttgttttgtattttgtttttcaaagctagcgctagctaaaatcattttatttgggttttatttgggttgtttctttttcttacctagaagcattattcccatttgaacttaataccttcagttcttgtgagtgaggtgactgccctggagacttagctcctctgtttatccacagaacagatacagcacgggcagcggcagtgcaagccacccacagccaccccgtgccactgtgtcccaaccctgacctggagggaccagctctcggggtaagagagggattctggcttgttccatgctcagcctccctgctgagagggccagtaagggtggtggcttctgttctccctggactcttgggcatctgaggcccacttaccccgccccgtaggccactgcgtgctgtgatttggtcacaccgcaggccttatgatacaacaggtcttttgtcactggatacagtggatgccagataaggtttctgaaggggagggctgctgctcttcagttcagttttacgctcccagtgaggggggaccatctctgttatttgacacctcgtatttcttacaaatctaattgtttctactcttagaaatagaatctaaccaatgcaactctgatcattatgtgctgtgctgtggaaaggaaagatttttttaaaaatcaactgggaaggaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattagccaccaaggccaggtgcagtggctcacacctgtaatcccagcactttgggaagctgaggcagggggattgcttgagtccaggagttcaagaccagtctgggcaacatagtgagatcccatctctcaaaaaaataataatctagaaaataaagattagccacccagttttctttctccagatgctaaagttgattcctgtttgataacagtattccagaaatgaggggaataacatatctgataggcccaagtcanctctggatagtacagtgtctggatagtacagattctgtgctcctgggacatgctttgtttattcctgccaggccagggattcagcagccctattccccaacccccgttactgtctctgtgggctagccaggctgtccgttatgtaagcacaacaggggcaaggtggggaaaccgtgtgtggaaaaggagtggagtggtggcgggtggccaaggtagactaggaagagtgggtacccagagaccacttgttcagaagttaactcctcttcccatctggcgtgagctactccattgaatggtgccaacaacagtaaagtgaaggagataatgttagattattttcagggatgattctccaagatgacagcagatcttaaaaccaaagagctgggtcctggaagaagggatcttggattattaacttctgatggaaggaccagagtgggagagagaagagttggggacctagaacatcaggaggaccctgggtctttggggatgaggcttcaccatcagctggaagaatccatgcttcacacacatgcctctgccattagtggtactgggatgtttagggtgacatccttgaggggagagccactgaaaagagggacattcacattttgctgtattcttgcagctgtccgtgtcttaataattcaagcgttcaataggtgtttgagggccaggcactgctcttgaggtgctggagataacggtgacaagcccaggtccctgacaagctccacaagcttaatggacagtgaatgtgcggctgttgcggctgttcacagggccgctggtgagggcaggtagaagaaagtgcagaccttcttaaatgcaggtgtaacggatctacatgaaagagcataattaacaccaatgtatacttaaggtagtaacagcttcttcataaagtagcaaaactaaggatctgtgggaaggttgctggtgcaaatgctttataagcttactagagactgagccttggatttaggactttagacgagtataggatggaacaaaatttttgcagtaaatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctgagtagctgggcccagctactcaggaggctacggactaagaagaagggtggcactgagcatgtgctgtagtccaggaatagtcagggacgcagataatttggttaaactgtctgatataataagggac

SEQ ID NO: 429565 - DNA, 4226 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagtaggtgagagtcatttttttcttatttctgcttggtttcaatttcgaccccagagataaaatggctagtccactgctgcgatgatgtgtgctgatcgtacacaggcctgggcaaagctggggctgccgaccctctgggtagaggagagaggggccaaggtcagggcaagtcctcagggtgttcgccagcctcgaggtggcagggtgagactctgcatgttgaatccaagccactcagtcaagacgtcataattgggattgtttctcgttttgttttgtattttgtttttcaaagctagcgctagctaaaatcattttatttgggttttatttgggttgtttctttttcttacctagaagcattattcccatttgaacttaataccttcagttcttgtgagtgaggtgactgccctggagacttagctcctctgtttatccacagaacagatacagcacgggcagcggcagtgcaagccacccacagccaccccgtgccactgtgtcccaaccctgacctggagggaccagctctcggggtaagagagggattctggcttgttccatgctcagcctccctgctgagagggccagtaagggtggtggcttctgttctccctggactcttgggcatctgaggcccacttaccccgccccgtaggccactgcgtgctgtgatttggtcacaccgcaggccttatgatacaacaggtcttttgtcactggatacagtggatgccagataaggtttctgaaggggagggctgctgctcttcagttcagttttacgctcccagtgaggggggaccatctctgttatttgacacctcgtatttcttacaaatctaattgtttctactcttagaaatagaatctaaccaatgcaactctgatcattatgtgctgtgctgtggaaaggaaagatttttttaaaaatcaactgggaaggaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttggagttgtg

SEQ ID NO: 429566 - DNA, 1185 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagaaaatcctttacattatttaataaaaattgaatccattttc

SEQ ID NO: 429567 - DNA, 536 bp, Homo sapiens
taatgactgctttgcatttgggagaaagtgaccaatatctgtgctgtctcccgaggtcagaggtttgtttaatgaagaagtgggttgcatccaggttgactccttgttttctgtcctcctgtgtccagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 429568 - DNA, 5304 bp, Homo sapiens
  misc_feature (3433)..(3433): n is a, c, g, or t
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtataggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggattagggacacttgtggaggccgggctcacccctgagcagataaagagactctccctgaggtgctttcagcgtaagcttttggcagccacccaactcagttctcgcatcttctgctcctaccttctcctctgtcttctttgaatttggatattccttccctggtccaagctcctatcttcggtcaaatgctgtttttactgcttcctaaggatagattatcaagaaatttaacagctcggccagctcagtgaaacactgaagctaatgggatgttgggtaagaaggttctgtgctgtctcattgaaaaccgagccagtcaaccacaaggctggcagggtgtgatccttgtaacgtcttgtgtctgttacctcacggatgtcggtaaggagtttccacagagccagctgtgtaccacagagactgagagtggtgagtggactttgtgagccaattatgtgtcggaaggacttggagtctgcccttcttcctgtatgtcatcatcagcccacaaatgcattcagtggcagtgacccagcaccatcaccatcacccactgctcagtctgtcttaggattccttatctttttctccatcatcatagagactgaaatttcaggggtgtttttgtacagtgtatttttttgtgggggggtgatacattggggttttttgtttgcatagagtgggaacggtgtgcaatgtgctcttaccacagaacttaaagtatgaataggctccattcttccgcaccatgggatccataagaagtgctcactttgcgaggtactctgagattagcgttccccatttgtttgacctacagacgttaagtgggtgacttgtgttacacacggggagtaaattcagagatggcacctgtagtctttgcagtctgttgatacttctaaataactaactggatgactttttggggattgaccagcagatgccatctcttgccctcttgattcacctgcttgccttaatttgtccctaaattcaactaaacttcaataagaggggttgtcaaggccatggggcgcacttggaagcactgcctgggctggagcgttggaggcattggcaggcaggtgggaaggagctctcactgcagtgttcacaggcagggaggctgtgtgtggatgtgttagaattgtgtgctgttgcctctcaaaatatccactagaaacaggtgtaaccaggaaaatacaggtctctgctcactgttattaacagactgtcatttcctgacattgggtcatgtggctttactctaggaggctggttctctatttttgtcttagttcaattttctgcatcctcaaatgccaaccccagtatgtggctgggtaggtagaactgtgctgcctgcctgccatgggggctgctctccctccttacccccacgcccacagcccccttggttctgtggtgggcacaggatgtgtttgggtgtgagtaaagtcaaactctgaatgtataatctcttggtagtaatatctgagtggtgttgctactcctgctttttaaaaagacttttcttgccatctataaaaagcttttttctttttcccagcattgctcctgtgctgccacgcttgccctttttccttaccttcctttcagttttctatcaacaactcctctaaacttcagtttaaaataaaaaacagcccaaaaaggctctttgccaccagggggcgtggtaggacacgttgccagtggtctggataggggagcagaaattttgaattttaaaaattagccaccaaggccaggtgcagtggctcacacctgtaatcccagcactttgggaagctgaggcagggggattgcttgagtccaggagttcaagaccagtctgggcaacatagtgagatcccatctctcaaaaaaataataatctagaaaataaagattagccacccagttttctttctccagatgctaaagttgattcctgtttgataacagtattccagaaatgaggggaataacatatctgataggcccaagtcanctctggatagtacagtgtctggatagtacagattctgtgctcctgggacatgctttgtttattcctgccaggccagggattcagcagccctattccccaacccccgttactgtctctgtgggctagccaggctgtccgttatgtaagcacaacaggggcaaggtggggaaaccgtgtgtggaaaaggagtggagtggtggcgggtggccaaggtagactaggaagagtgggtacccagagaccacttgttcagaagttaactcctcttcccatctggcgtgagctactccattgaatggtgccaacaacagtaaagtgaaggagataatgttagattattttcagggatgattctccaagatgacagcagatcttaaaaccaaagagctgggtcctggaagaagggatcttggattattaacttctgatggaaggaccagagtgggagagagaagagttggggacctagaacatcaggaggaccctgggtctttggggatgaggcttcaccatcagctggaagaatccatgcttcacacacatgcctctgccattagtggtactgggatgtttagggtgacatccttgaggggagagccactgaaaagagggacattcacattttgctgtattcttgcagctgtccgtgtcttaataattcaagcgttcaataggtgtttgagggccaggcactgctcttgaggtgctggagataacggtgacaagcccaggtccctgacaagctccacaagcttaatggacagtgaatgtgcggctgttgcggctgttcacagggccgctggtgagggcaggtagaagaaagtgcagaccttcttaaatgcaggtgtaacggatctacatgaaagagcataattaacaccaatgtatacttaaggtagtaacagcttcttcataaagtagcaaaactaaggatctgtgggaaggttgctggtgcaaatgctttataagcttactagagactgagccttggatttaggactttagacgagtataggatggaacaaaatttttgcagtaaatgtaaaaaatgctgtgtaggaggaaggcgtataaggatgccccagctgtaggttctttagattgtctgtagtatttccacgagtaagttgtttttgatgtgtgtactggtattgctggtagatttgaagtggagtctggcggcttcttccacactcccctcccactagcttgtgtcaagatgtgacatcctatgcagcaaaactaggtgagcttgcacccccaggcggtggctctcaactttgtctcattgttcagaaatttcggccaggcgccgtagctcacccctgtaatcccagcactttgggaggccatggcaggtggatcacttgaggtcaggagttcaagaccagcctggccaacacggtgaaaccccgtctctactaaaaatacaaaaattagccaggtgtggtggcacatgcctgtagtcccagctacttggtcaactcaggcaggagaatcacttgaacccaggaggcagaggttgcagtgagctgagatcaagccactccagcctgggtgacagaccgagactctgtctttaaaaaaaaagaaatgtcatctaagccccagtgaacctcctgggaggagagctagccctggccagctgtctccaaagtgactggatgctacagaagaactgggactgtcttctgcacactcgtgcctcctggagttgtcagaacactgagcagtctcctagttctgcgtccgtctagccatggggtctgccatgaaagcctgtggatctgctattgggttggtattttaaactttcacttgggtgaaacttgttcatcattttaaataaagcaacatgatttggagttgtg

SEQ ID NO: 429569 - DNA, 1780 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagatacagcacgggcagcggcagtgcaagccacccacagccaccccgtgccactgtgtcccaaccctgacctggagggaccagctctcggggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 429570 - DNA, 2452 bp, Homo sapiens
aagacggcggccgcttgcccaacccgaggctcgggaggtggctggggagtgaattttctggaaggcgactttaaaggcgccgggactgagcgaagggcgtttgggtactgccgtcgccgccgcccaggccggggaggggtgcgttagtgtcaggaagcgggctgcgccgaggtcgtagcggaaccagctggcgaccccgcagaatgaaccacaagagcaagaagcgcatccgcgaggccaagcggagtgcgcggccggagctcaaggactcgctggattggacccggcacaactactacgagagcttctcgctgagcccggcggccgtggcggataacgtggaaagggcagatgctttacagctgtctgtggaagaatttgtggagcggtatgaaagaccttacaagcccgtggttttgttgaatgcgcaagagggctggtctgcgcaggagaaatggactctggagcgcctaaaaaggaaatatcggaaccagaagttcaagtgtggtgaggataacgatggctactcagtgaagatgaagatgaaatactacatcgagtacatggagagcactcgagatgatagtcccctttacatctttgacagcagctatggtgaacaccctaaaagaaggaaacttttggaagactacaaggtgccaaagtttttcactgatgaccttttccagtatgctggggagaagcgcaggcccccttacaggtggtttgtgatggggccaccacgctccggaactgggattcacatcgaccctctgggaaccagtgcctggaatgccttagttcagggccacaagcgctggtgcctgtttcctaccagcactcccagggaactcatcaaagtgacccgagacgaaggagggaaccagcaagacgaagctattacctggtttaatgttatttatccccggacacagcttccaacctggccacctgaattcaaacccctggaaatcttacaaaaaccaggagagactgtctttgtaccaggaggctggtggcatgttgtcctcaatctcgacactactatcgccatcacccaaaattttgccagcagcaccaacttccctgtggtatggcacaagacggtaagagggagaccaaagttatcaaggaaatggtatagtaggtgagagtcatttttttcttatttctgcttggtttcaatttcgaccccagagataaaatggctagtccactgctgcgatgatgtgtgctgatcgtacacaggcctgggcaaagctggggctgccgaccctctgggtagaggagagaggggccaaggtcagggcaagtcctcagggtgttcgccagcctcgaggtggcagggtgagactctgcatgttgaatccaagccactcagtcaagacgtcataattgggattgtttctcgttttgttttgtattttgtttttcaaagctagcgctagctaaaatcattttatttgggttttatttgggttgtttctttttcttacctagaagcattattcccatttgaacttaataccttcagttcttgtgagtgaggtgactgccctggagacttagctcctctgtttatccacagaacagatacagcacgggcagcggcagtgcaagccacccacagccaccccgtgccactgtgtcccaaccctgacctggagggaccagctctcggggtaagagagggattctggcttgttccatgctcagcctccctgctgagagggccagtaagggtggtggcttctgttctccctggactcttgggcatctgaggcccacttaccccgccccgtaggccactgcgtgctgtgatttggtcacaccgcaggccttatgatacaacaggtcttttgtcactggatacagtggatgccagataaggtttctgaaggggagggctgctgctcttcagttcagttttacgctcccagtgaggggggaccatctctgttatttgacacctcgtatttcttacaaatctaattgtttctactcttagaaatagaatctaaccaatgcaactctgatcattatgtgctgtgctgtggaaaggaaagatttttttaaaaatcaactgggaaggaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 429571 - DNA, 692 bp, Homo sapiens
cctcaccattgtacagtatccattctgaacggacacacctggcattcccaggtgtttctgagagacacaggcctcgactctgagtgagtctttgtgagtgggtatggctgtcagtgcactgagaacaacacttcttgcctctcaggattttgaagcaagagcaccccgagttggcagtcctcgcagactcggttgaccttcaggagtccacagggatagcttccgacagctccagcgactcttccagctcctccagctccagttcgtcagactccgactcagagtgcgagtctggatccgagggcgatgggacagtgcaccgcaggaagaagaggaggacgtgcagcatggtgggaaacggggacaccacctcccaggacgactgtgtcagcaaagagcgcagctcctccaggtgacccagcaaggctgttgtctgtatggaaggacacgctcgcggcaagggcagggcctggggagggtggcctgtccagtcctgcagacaaggggaggcctgacagagcccaagaatgaggacaccctcggcacgggaacccattcacttagcgtttgctccagtagctttccctctgctaccaatgcagataaacgcggcttgttttactcaggcaagagaatgtgaatagtgccaagaaaatcctttacattatttaataaaaattgaatccattttc

SEQ ID NO: 429572 - DNA, 768 bp, Homo sapiens
ctattaggatacagaacaatctaagagtaagcttgatagacatgatgtgacttcacttaaatggagtagagtgaataatgtaaggacactcacctctgttgaaattggtgatttctgcattttgtagacctttgccctctaagtttatcatcatattatctgttgaatctgaacagcatttgaagtcctctcaaagagtttgagctttcaggattaggttcccctgtgagtctttcacttgtgtaatggtaagtcaacattgatgatctttctaaggaaatcagatttacaaaatgctgagccgcttgatgtctaagtgttggtggtttttgctgttgctttgctgttccatgaaagcgctccctggctgcttggagggctgtgcttttccaggtcagtgccagcttggctgtcccaggccgtgcacagtgcccattgctatagctgggcccagtcctggccacgccggagcctcggcgggggcagctgggttgtcacggcagcacagtgcacatgcagagaggaccaggccatgtttttcctgtgctgagaaactcttgggttatttaatttttccaatgtgttttcataactcatgattatttgaaatacacttgtgttagtaactgcttctataattaagtggtcactgtaaaaaggcgaataacctatttttatatcagaatgtccaaaactcatgggtttgctttgttatagaaaaatgtgccattcatttgttgggtagaataaagttgtcttgtaattgta

SEQ ID NO: 429573 - DNA, 2515 bp, Homo sapiens
tgagcctgcgcttcggaagcatggatgtgcgcctgcgctgcgctagggcgcggcgggcggtttgaattttgcttacagagtcccgtctcaccatcctgggcttccaacggagactgcggtatccgcggctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacattccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttggagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttgagacagtctcgctctttcacccaggccggactgcagcggcgctatctcggctcactgcaaactctgcctcccaggttcacgccatcctcctgcctcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaa

SEQ ID NO: 429574 - DNA, 741 bp, Homo sapiens
caggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtg

SEQ ID NO: 429575 - DNA, 916 bp, Homo sapiens
tctcggcctccttaccgatcccaaactgtaaagccccaacccctcacagcacaggaaaaatgattacctgggcccatttctttgacagtgtaacacatttttaaaaaatgtgtccttattttgcgtgtttaaagaaaataccaatgttgtctttatatacaaatagtgcgtttgtcctcctgaatccttaaggaaaggacccaggcttatcctctttcccctggtttgggatccatcgatggcctaaggctctaagacaagtcagtacggtaccgtggttagaaactgaatgttgtagaaatgaaagaaattgctcttgaatttttgtgcttaaccttcaaagacatgtgatttacttgacattgaccattcttggatttcgaaagtgaacagaaatttgtgtggcttttcttgttacgaatatgtttatgtttttttcttcagaggcttaaaggatggcctcgtcagatctggaacaattatgctctcatgttaatgaaaagattggcaatattaagaaaaccttatcattaagaaactgtggtgttctcttgcaactagcaagtgaaggcttgccaaatgacatgaccttggatcttgcttaccttctgccttagcacaacgtgtgagatgctaaccgggcttgaaaagccgccccctctgattaatctctccagctgggaggtattacatagcgtcagattatgccgaggggccatgttcacggacagtgcacccttacaggtgatccaagaataatagaagccaggcatgcacggatgacccagcggctgaactatttcgggaaacgaacgtcagagccgagaccggacctcggcgagggaaggacaaacaccaaaaccgggaaaacgaacacccaacaccgccaacgaccaggcaagcatacaaatccacc

SEQ ID NO: 429576 - DNA, 3126 bp, Homo sapiens
  misc_feature (2957)..(2957): n is a, c, g, or t
  misc_feature (3050)..(3050): n is a, c, g, or t
tgagcctgcgcttcggaagcatggatgtgcgcctgcgctgcgctagggcgcggcgggcggtttgaattttgcttacagagtcccgtctcaccatcctgggcttccaacggagactgcggtatccgcggctggagacccagcggcgagtagccttttgctcccggacggacttgaggttggagtctgtgtgttggggaccctgcctttggaagcgcccgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacattccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttggagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttgagacagtctcgctctttcacccaggccggactgcagcggcgctatctcggctcactgcaaactctgcctcccaggttcacgccatcctcctgcctcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaaaaaaaaaaaaaaaaaaaaaaaaaaaaaaaaaaaaaaaaaaaaaaaaaggggggggcgccaccaaaaaggtgcccggggggggaccaaaacctggggggggccccattctgtggacaacaggggcccccataggaggggggccccaaaagaggggtcggcccgtaaaaggggggagtggggaaaacgcgtcgggggacccttggacacgaccacccactgctggaggggagccacacatcggcagaacgcaccaaaggaaaattaacccgcccaaggcagaaacacacacccttgcttaggacagtaacagggagaccacaaacacacagttcacacagcgcagcagctgcgacaccgagcgtctttacccaaatcttccaagtcaccacgcaggagncagcagaactacagcaagccagaaacagtacgaaaccggactggagcccagacatctagcgtagacccagccagaacgagaggaagagcaaanaggaaaagcacaacgacccgcgagaagaagagccagaacatagtccgtgagcacagacgcacgcaggaagcaagtg

SEQ ID NO: 429577 - DNA, 1865 bp, Homo sapiens
  misc_feature (1696)..(1696): n is a, c, g, or t
  misc_feature (1789)..(1789): n is a, c, g, or t
caggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaaaaaaaaaaaaaaaaaaaaaaaaaaaaaaaaaaaaaaaaaaaaaaaaaggggggggcgccaccaaaaaggtgcccggggggggaccaaaacctggggggggccccattctgtggacaacaggggcccccataggaggggggccccaaaagaggggtcggcccgtaaaaggggggagtggggaaaacgcgtcgggggacccttggacacgaccacccactgctggaggggagccacacatcggcagaacgcaccaaaggaaaattaacccgcccaaggcagaaacacacacccttgcttaggacagtaacagggagaccacaaacacacagttcacacagcgcagcagctgcgacaccgagcgtctttacccaaatcttccaagtcaccacgcaggagncagcagaactacagcaagccagaaacagtacgaaaccggactggagcccagacatctagcgtagacccagccagaacgagaggaagagcaaanaggaaaagcacaacgacccgcgagaagaagagccagaacatagtccgtgagcacagacgcacgcaggaagcaagtg

SEQ ID NO: 429578 - DNA, 2818 bp, Homo sapiens
  misc_feature (2649)..(2649): n is a, c, g, or t
  misc_feature (2742)..(2742): n is a, c, g, or t
tgagcctgcgcttcggaagcatggatgtgcgcctgcgctgcgctagggcgcggcgggcggtttgaattttgcttacagagtcccgtctcaccatcctgggcttccaacggagactgcggtatccgcggctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggaactctgtgaatctcttgaagaagattacaaagacatagaacatcttaaagaaaacattccttcccatttgcctcaagtaacagtaacccagagctggtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttggagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttgagacagtctcgctctttcacccaggccggactgcagcggcgctatctcggctcactgcaaactctgcctcccaggttcacgccatcctcctgcctcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaaaaaaaaaaaaaaaaaaaaaaaaaaaaaaaaaaaaaaaaaaaaaaaaaggggggggcgccaccaaaaaggtgcccggggggggaccaaaacctggggggggccccattctgtggacaacaggggcccccataggaggggggccccaaaagaggggtcggcccgtaaaaggggggagtggggaaaacgcgtcgggggacccttggacacgaccacccactgctggaggggagccacacatcggcagaacgcaccaaaggaaaattaacccgcccaaggcagaaacacacacccttgcttaggacagtaacagggagaccacaaacacacagttcacacagcgcagcagctgcgacaccgagcgtctttacccaaatcttccaagtcaccacgcaggagncagcagaactacagcaagccagaaacagtacgaaaccggactggagcccagacatctagcgtagacccagccagaacgagaggaagagcaaanaggaaaagcacaacgacccgcgagaagaagagccagaacatagtccgtgagcacagacgcacgcaggaagcaagtg

SEQ ID NO: 429579 - DNA, 3081 bp, Homo sapiens
  misc_feature (2912)..(2912): n is a, c, g, or t
  misc_feature (3005)..(3005): n is a, c, g, or t
tgagcctgcgcttcggaagcatggatgtgcgcctgcgctgcgctagggcgcggcgggcggtttgaattttgcttacagagtcccgtctcaccatcctgggcttccaacggagactgcggtatccgcggctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacattccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttggagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttgagacagtctcgctctttcacccaggccggactgcagcggcgctatctcggctcactgcaaactctgcctcccaggttcacgccatcctcctgcctcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaaaaaaaaaaaaaaaaaaaaaaaaaaaaaaaaaaaaaaaaaaaaaaaaaggggggggcgccaccaaaaaggtgcccggggggggaccaaaacctggggggggccccattctgtggacaacaggggcccccataggaggggggccccaaaagaggggtcggcccgtaaaaggggggagtggggaaaacgcgtcgggggacccttggacacgaccacccactgctggaggggagccacacatcggcagaacgcaccaaaggaaaattaacccgcccaaggcagaaacacacacccttgcttaggacagtaacagggagaccacaaacacacagttcacacagcgcagcagctgcgacaccgagcgtctttacccaaatcttccaagtcaccacgcaggagncagcagaactacagcaagccagaaacagtacgaaaccggactggagcccagacatctagcgtagacccagccagaacgagaggaagagcaaanaggaaaagcacaacgacccgcgagaagaagagccagaacatagtccgtgagcacagacgcacgcaggaagcaagtg

SEQ ID NO: 429580 - DNA, 3001 bp, Homo sapiens
  misc_feature (2832)..(2832): n is a, c, g, or t
  misc_feature (2925)..(2925): n is a, c, g, or t
tgagcctgcgcttcggaagcatggatgtgcgcctgcgctgcgctagggcgcggcgggcggtttgaattttgcttacagagtcccgtctcaccatcctgggcttccaacggagactgcggtatccgcggctggagacccagcggcgagtagccttttgctcccggacggacttgaggttggagtctgtgtgttggggaccctgcctttggaagcgcccgagaggcttaaaggatggcctcgtcagatctggaacaattatgctctcatgttaatgaaaagattggcaatattaagaaaaccttatcattaagaaactgtggaactctgtgaatctcttgaagaagattacaaagacatagaacatcttaaagaaaacattccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttggagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttgagacagtctcgctctttcacccaggccggactgcagcggcgctatctcggctcactgcaaactctgcctcccaggttcacgccatcctcctgcctcccagctactcaggagaattgcttgaacctgggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaaaaaaaaaaaaaaaaaaaaaaaaaaaaaaaaaaaaaaaaaaaaaaaaaggggggggcgccaccaaaaaggtgcccggggggggaccaaaacctggggggggccccattctgtggacaacaggggcccccataggaggggggccccaaaagaggggtcggcccgtaaaaggggggagtggggaaaacgcgtcgggggacccttggacacgaccacccactgctggaggggagccacacatcggcagaacgcaccaaaggaaaattaacccgcccaaggcagaaacacacacccttgcttaggacagtaacagggagaccacaaacacacagttcacacagcgcagcagctgcgacaccgagcgtctttacccaaatcttccaagtcaccacgcaggagncagcagaactacagcaagccagaaacagtacgaaaccggactggagcccagacatctagcgtagacccagccagaacgagaggaagagcaaanaggaaaagcacaacgacccgcgagaagaagagccagaacatagtccgtgagcacagacgcacgcaggaagcaagtg

SEQ ID NO: 429581 - DNA, 1140 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429582 - DNA, 461 bp, Homo sapiens
  misc_feature (45)..(45): n is a, c, g, or t
  misc_feature (50)..(50): n is a, c, g, or t
agatttaagttaaaaagtggtttggacttgggaacaggactttanacctnttttactgtaacaagtactcattaaaggaaattgaatgaaaaaaaaaaaaaaaaaactcggcaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429583 - DNA, 1075 bp, Homo sapiens
ctcaaactccagagcccatcttggcctcccaaagtactgggattacaggtgtgagctaccacgcctggccaactccagggttcttatctggggctttcccagcttcgtggaaggactgaggcctggtgagagaaggggctggccttaagtaccccagtgtcctggcgtcacagctcctcttgggcctcagcttccatggccatcccagggggacacagcagggtatgtgaggctcagggacatgaaaacttcctatttccaaggccacaccctgcacccaggcccctgaacccctgagacttcatgacagccctgggtgtccacccagaaaaacatgcactgtgtttgtagctcatatccgtgggtctgcaggtgagtcacacccttatcttcaagttaaaaacaagagcagcaaatataataataagaagaagccctgcaggtattatcttaaatctcaaagcaatcctattgaacagatacaattattcccactttacaaacaaggaaactgaggctcagagaggttaagtaatttacccaaggtcacacagctaccaagtagtggggctgcaatagaaacccagcagttgattccagtccataggcctgtgccagtcattgttatgagccttttgcaactactgtcttcacaattcccctaagagatggggaaaaccaaggtgcacagctgggatccaaacccaggcctgtctgacagcaaagcactgtgtctggactttggagttaggctgcctgggttcaaatgccaggtctactcaagtctcctccttacttgctgtctgaccctggacaagtcacctggcctctctgtgcctcaggttccatacctgtgaagtgggtaagaatgctgacttcacagggtggtgaaagttaaatgcaataaggcacgtggtcgaccagccacagcgagcagtctgcagagggttgttcttattacactttagtgagcactgccggctgctgacatccaggccacaggaggaaactggtgggagcagccagggactccgggcgcccactgctgtggctgcgctagagccatgctttccag

SEQ ID NO: 429584 - DNA, 1180 bp, Homo sapiens
cagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429585 - DNA, 1150 bp, Homo sapiens
tgtgagccatccttgcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429586 - DNA, 1930 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcaaaaaaaaaaaaaaaaaaaaaaaaaaaaaaaaaaaaaaaaaaaaaaaaacaacacacacacaaaaaaacaaaaaaaaacaaaaaaaaaaaaaaaaaaaaaaacaacacaaccaacaaaaaaaaacagaacaaaaacagagagagggggggggcgacggacgacgagacaaaggcacagggacggacaggcggcagggaccagggagatgacaagaagagagggaggagagccacggggaagaaaaagagagcaaggaggcagggcggcacacagcgcgagggaggaggcgggaaaggcaggggagagcggcgaagcagggacgagagacagcacgagaggcggagcgagaacacgaacacagagagcccacaccgcaagacaaccaggaccagaaaccaccgcagcccggaaggacccaacaccacaccgccgccggagcgcaagcaacggaaaccaacaccagaaagagccggcggagagccaaacgcggagccgagacgacaacgaagaacataaccacgacggccgagcagcgcaccacagcgccgcagccgggggcaaggcggccgcgcccccgacgccgcgacgaggcgcagcgcccgcgcgggcgcgggcggggacgcggccgggcgggggacgagggcgcaccgggaccgggaagaaagggcggacgggagagggggcgagagaggcgcggggcgggcgacagcacgccaagcgcacggcggaccggcggggcgcggcagagacacgaccggaccgaggcaagaacggagacgacatcgacac

SEQ ID NO: 429587 - DNA, 1593 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcaaagaagagaaagatgggataaaccaaccctccgcgggtgctttatttccgtggtgcgggacaaaagcgtacagttgcacgggcggatgggcaaatggggtcctccgggatggccagacttttgctgtgcccacaggggggcgacaaatcagggcgggtggccaccggatatacggcacgcatactcattctccaacagtgcccgttgaccctggtcttaaggtgcccggcacgaagttccttgtcgccccatggggaccaccatgaccgtgagtacccagatgagtacacgacaaggggggaacaagctggacaggccacgaatcgtggtgcaggaatggctgagaggcacaaaggcagcgcaggatacgatgtggaccgcgctgaagctcctgtagggcatcccctggacccgcctgtgcacgccgtatcaatgggtctcaatttcagaca

SEQ ID NO: 429588 - DNA, 1424 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcgcttctggtctgtgtgtctgtggctggggtgaagtaaggggaccccgggcctgaaaccctctcccaccttctcctgccatctccagttactgccctgctcctcccaccctggcccagggaaggactgggtgtcctccggccatatggtccctgaagcctctagggaccagagtccctagtaagtgggctctgtgctcagctgagaccagcaggggacaggggacggagggaatgggcctcatggccttctcagggcttgtgggaaagggaggaccatgggaatc

SEQ ID NO: 429589 - DNA, 1083 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctggggtcactgtgggaacatctgcctcagctcggcacgcgcttctcctggctgtccacctcctctgtctgtccctcctctggctgccccct

SEQ ID NO: 429590 - DNA, 1018 bp, Homo sapiens
cagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctgggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429591 - DNA, 896 bp, Homo sapiens
caggtagttgcgtttcttctcaggtagttgcgtttcttctgtcataagataggctttatctccatcagtaggaggctttcaacatgattgaccagaaccgtgatggcttcattgacaaggaggacctgcacgacatgctggcctcgctgggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429592 - DNA, 995 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagcgcgggtgccgctagaggcctgaagaagagcgtcccacaggacaggggttggaggcagcatgaaggcctggagaggagcgtcccacaggacaggggttggaggcagcatgaaggcctgtatcgggagcgcggcctctagcggcaccgggtaccgagc

SEQ ID NO: 429593 - DNA, 1442 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcaaagaagagaaagatgggataaaccaaccctccgcgggtgctttatttccgtggtgcgggacaaaagcgtacagttgcacgggcggatgggcaaatggggtcctccgggatggccagacttttgctgtgcccacaggggggcgacaaatcagggcgggtggccaccggatatacggcacgcatactcattctccaacagtgcccgttgaccctggtcttaaggtgcccggcacgaagttccttgtcgccccatggggaccaccatgaccgtgagtacccagatgagtacacgacaaggggggaacaagctggacaggccacgaatcgtggtgcaggaatggctgagaggcacaaaggcagcgcaggatacgatgtggaccgcgctgaagctcctgtagggcatcccctggacccgcctgtgcacgccgtatcaatgggtctcaatttcagaca

SEQ ID NO: 429594 - DNA, 712 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccgccactgccgcacacccacccagagcacgccacccgccatgggagtgtgctcaggagtcgcgggcagcgtggacatctgtcccagagggggcagaatctccaatagaggactgagcactgc

SEQ ID NO: 429595 - DNA, 771 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacacccctcagagatgatagatgctagactactacaactggaaacccagggaaatcaaagttgctacaactatctgtataggatgaaagctctggatgacattcgtaacctctgagatcccatgagcattctgaaggccggcatccccgattccttaatgggcaagaatttccgctcctacctgctg

SEQ ID NO: 429596 - DNA, 970 bp, Homo sapiens
cagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctgggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacacccccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429597 - DNA, 614 bp, Homo sapiens
gaggtggacaggcgggggtttgactgcccagagcctcctagaacctcaggcgggcagcagagggatggagtgggagagtgaggaacggcaggaatgcaggaatgctgatccagctccttcctgcagggccagggagcctggatggcagcccaggagagccctcactgactcccacgagtggacccaccttgtcacttggaaagagagagggacagtgtaaatgctattaaggattaaaggagataaagcatggtaatggttggcaccaagcccaatcctaagtgttttacccaaacagtcacagccaaaatagctgattccatgcccggcactgttccaggagctctcgggcactgagtcagttaatccctactgctgggcactcctcatgtctccagtcccagatgaagactctcgggctcagagaggtagaggaagttgttcagaatcacacagccacacttgtctgcttttgtgaagaactgggtggtgggagccccaaatccgtgggcagccttgaatgccaggccgaagtgctaaaagccagtctgggggaggcaggaagattccctggcccagagtcacagggccacccaacccccaccccttcctgc

SEQ ID NO: 429598 - DNA, 619 bp, Homo sapiens
tacactttagtgagcactgccggctgctgacatccaggccacaggaggaaactggtgggagcagccagggactccgggcgcccactgctgtggctgcgctagagccatgctttccagttcacaaaacccactacctcccgtctcacacggagcggtgaagggcaggggtgggggacgggggtgcaagttgtcccagctggggacagagggcccaggaccacaggctggaacaccccacctgccacagggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtccgtggcgccccctaccaccactctgcatgcaagtggaacagggcccaggcattcagtgcctctgcccctaagggccagaacagacatcacccatctcccaggttctgtcaccagaactataaaagccaggccacctccttattgtcgccgcaaaggctaggccagaacagcccatgccccaagactcctgccttcgtgatctccccc

SEQ ID NO: 429599 - DNA, 603 bp, Homo sapiens
tgtgagccatccttgcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctgggtgagctgggacagggacaggggtgagatggatgaggccaggcaggctctgccaatcatttacagggcacctcctgtgtagtgagacgcgtggtgtccaccttagagaatagttgccattaacttagtccattcaacagggaaactgggccgggcgcggtggctcacgcctgtaatcccagcactttgggaggccaaggcgggcggatcaataggtcaggagatcgagaccatcctggctaacacggtgaaaccctgactctgctaaaaataccaaaaattagccgagcgtggtggcgggcgcctgtagtcccagctacttgggaggctgaggcaggagaatggcgtgaacccggaaagcg

SEQ ID NO: 429600 - DNA, 1268 bp, Homo sapiens
cagacccgacggccggcccagttccacgcacccagcgagcccaagcgccttctccgcaccaggagctctcgggcactgagtcagttaatccctactgctgggcactcctcatgtctccagtcccagatgaagactctcgggctcagagagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgc

SEQ ID NO: 429601 - DNA, 1752 bp, Homo sapiens
ccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcaaaaaaaaaaaaaaaaaaaaaaaaaaaaaaaaaaaaaaaaaaaaaaaaacaagaggggggggccacgcactaatgaagatatctccccgccgaggaggggcgccacgagcttcatacgcggatcagccaagcttctgctgggagaacaagcggggcgcccactataataggaggaggtcctaattataatcgaacgatagagcgacgtgggcgcgcgcgaggtataatcacaaacgggttgagacacgggggcgaaaacaaggcgtgcgcccacgctgaggggccacccacttggggggtgaacgagagacaacactctatgaactccgagtgggggggcgcgagcaccaaatagcggtggggcaccccaaaatgactacctctcttgagacgaagagatattttaacagcgcctcttcatctgagggggaatacaatctatatacaccaattttctagacacaggatgggattattatctgcgtgtgggtcaatacaccaccagttgcgctggcgataattatgggtgctgggtggcctgaccttatgaaacatgatttgggctctactgccggggacattgcgtgtctttgttgtccaaacacattttct
